(12) United States Patent
Obad et al.

(10) Patent No.: US 8,288,356 B2
(45) Date of Patent: Oct. 16, 2012

(54) MICRORNAS

(75) Inventors: Susanna Obad, Malmo (SE); Sakari Kauppinen, Smorum (DK); Joacim Elmen, Malmo (SE); Morten Lindow, Copenhagen (DK); Markus Heidenblad, Lund (SE)

(73) Assignee: Santaris Pharma A/S, Hørsholm (DK)

( * ) Notice: Subject to any disclaimer, the term of this patent is extended or adjusted under 35 U.S.C. 154(b) by 360 days.

(21) Appl. No.: 12/245,544

(22) Filed: Oct. 3, 2008

(65) Prior Publication Data

US 2009/0143326 A1 Jun. 4, 2009

Related U.S. Application Data

(60) Provisional application No. 61/028,062, filed on Feb. 12, 2008, provisional application No. 60/979,217, filed on Oct. 11, 2007, provisional application No. 60/977,497, filed on Oct. 4, 2007.

(30) Foreign Application Priority Data

Jul. 17, 2008 (EP) .................................. 08104780

(51) Int. Cl.
*A61K 31/70* (2006.01)
*C07H 21/02* (2006.01)
*C07H 21/04* (2006.01)
(52) U.S. Cl. ..................... 514/44 A; 536/24.1; 536/24.5
(58) Field of Classification Search ................ 536/23.1, 536/24.3, 24.33, 24.5
See application file for complete search history.

(56) References Cited

U.S. PATENT DOCUMENTS

| | | | |
|---|---|---|---|
| 4,914,210 A | 4/1990 | Levenson et al. |
| 4,920,115 A | 4/1990 | Nestler et al. |
| 4,962,029 A | 10/1990 | Levenson et al. |
| 5,919,795 A | 7/1999 | Chang et al. |
| 6,030,785 A | 2/2000 | Katze et al. |
| 6,121,283 A | 9/2000 | Chang et al. |
| 6,284,458 B1 | 9/2001 | Anderson et al. |
| 6,423,489 B1 | 7/2002 | Anderson et al. |
| 6,433,159 B1 | 8/2002 | Anderson et al. |
| 7,087,229 B2 | 8/2006 | Zhao et al. |
| 7,307,067 B2 | 12/2007 | Sarnow et al. |
| 2003/0068320 A1 | 4/2003 | Dingivan |
| 2004/0204356 A1 | 10/2004 | Guenzler-Pukall et al. |
| 2005/0069522 A1 | 3/2005 | Colonno et al. |
| 2005/0182005 A1 | 8/2005 | Tuschl et al. |
| 2005/0227934 A1 | 10/2005 | Stoffel et al. |

(Continued)

FOREIGN PATENT DOCUMENTS

EP 0 699 751 A1 3/1996

(Continued)

OTHER PUBLICATIONS

Abelson, J., et al., "Sequence Variants in *SLITRK1* Are Associated with Tourette's Syndrome," Science 310:317-320, American Assn. for the Advancement of Science, United States (2005).

(Continued)

*Primary Examiner* — Terra Cotta Gibbs
(74) *Attorney, Agent, or Firm* — Sterne, Kessler, Goldstein & Fox, P.L.L.C.

(57) ABSTRACT

The present invention relates to very short heavily modified oligonucleotides which target and inhibit microRNAs in vivo, and their use in medicaments and pharmaceutical compositions.

52 Claims, 40 Drawing Sheets

U.S. PATENT DOCUMENTS

| | | | |
|---|---|---|---|
| 2005/0261218 A1 | 11/2005 | Esau et al. | |
| 2006/0035212 A1 | 2/2006 | Balakireva | |
| 2006/0035858 A1 | 2/2006 | Geary et al. | |
| 2006/0040989 A1 | 2/2006 | Meerpoel et al. | |
| 2006/0058266 A1 | 3/2006 | Manoharan et al. | |
| 2006/0185027 A1 | 8/2006 | Bartel et al. | |
| 2006/0265771 A1 | 11/2006 | Lewis et al. | |
| 2007/0049547 A1 | 3/2007 | Esau et al. | |
| 2009/0082297 A1 | 3/2009 | Lioy et al. | |
| 2009/0143326 A1 | 6/2009 | Obad et al. | |
| 2009/0298916 A1 | 12/2009 | Kauppinen et al. | |
| 2010/0004320 A1 | 1/2010 | Elmen et al. | |
| 2010/0280099 A1 | 11/2010 | Elmen et al. | |
| 2010/0286234 A1 | 11/2010 | Elmen et al. | |
| 2010/0298410 A1* | 11/2010 | Obad et al. ................. | 514/44 A |
| 2010/0330035 A1 | 12/2010 | Hildebrandt-Eriksen et al. | |
| 2011/0077288 A1 | 3/2011 | Kauppinen et al. | |
| 2011/0146216 A1 | 6/2011 | Willink et al. | |

FOREIGN PATENT DOCUMENTS

| | | | |
|---|---|---|---|
| EP | 1 099 442 A2 | 5/2001 | |
| EP | 0 662 157 B1 | 6/2001 | |
| EP | 1 222 309 B1 | 7/2005 | |
| EP | 1747023 B1 | 1/2011 | |
| EP | 1931782 B1 | 1/2011 | |
| WO | WO 95/30746 A1 | 11/1995 | |
| WO | WO 99/14226 A2 | 3/1999 | |
| WO | WO 00/56746 A2 | 9/2000 | |
| WO | WO 00/56748 A1 | 9/2000 | |
| WO | WO 00/66604 A2 | 11/2000 | |
| WO | WO 01/23613 A1 | 4/2001 | |
| WO | WO 01/25248 A2 | 4/2001 | |
| WO | WO 02/28875 A2 | 4/2002 | |
| WO | WO02/081494 A1 | 10/2002 | |
| WO | WO 02/094250 A2 | 11/2002 | |
| WO | WO 03/006475 A2 | 1/2003 | |
| WO | WO 03/011887 A2 | 2/2003 | |
| WO | WO 03/029459 A2 | 4/2003 | |
| WO | WO 03/070750 A2 | 8/2003 | |
| WO | WO 03/095467 A1 | 11/2003 | |
| WO | WO 2004/044181 A2 | 5/2004 | |
| WO | WO 2004/046160 A2 | 6/2004 | |
| WO | WO 2004/069991 A2 | 8/2004 | |
| WO | WO 2004/076622 A2 | 9/2004 | |
| WO | WO 2005/013901 A2 | 2/2005 | |
| WO | WO 2005/013905 A2 | 2/2005 | |
| WO | WO 2005/023986 A2 | 3/2005 | |
| WO | WO 2005/103298 A2 | 3/2005 | |
| WO | WO 2005/054494 A2 | 6/2005 | |
| WO | WO 2005/058824 A2 | 6/2005 | |
| WO | WO 2005/061710 A1 | 7/2005 | |
| WO | WO 2005/078139 A2 | 8/2005 | |
| WO | WO 2005/079397 A2 | 9/2005 | |
| WO | WO 2005/098029 A2 | 10/2005 | |
| WO | WO 2005/107816 A2 | 11/2005 | |
| WO | WO 2006/010423 A2 | 2/2006 | |
| WO | WO 2006/020676 A2 | 2/2006 | |
| WO | WO 2006/020768 A2 | 2/2006 | |
| WO | WO 2006/027776 A2 | 3/2006 | |
| WO | WO 2006/036916 A2 | 4/2006 | |
| WO | WO 2006/053430 A1 | 5/2006 | |
| WO | WO 2006/069584 A2 | 7/2006 | |
| WO | WO 2006/093526 A2 | 9/2006 | |
| WO | WO 2006/112872 A2 | 10/2006 | |
| WO | WO 2006/113910 A2 | 10/2006 | |
| WO | WO 2006/133022 A2 | 12/2006 | |
| WO | WO 2006/137941 A2 | 12/2006 | |
| WO | WO 2007/021896 A2 | 2/2007 | |
| WO | WO 2007/027775 A2 | 3/2007 | |
| WO | WO 2007/027894 A2 | 3/2007 | |
| WO | WO 2007/031081 A2 | 3/2007 | |
| WO | WO 2007/031091 A2 | 3/2007 | |
| WO | WO 2007/090073 A2 | 8/2007 | |
| WO | WO 2007/112753 A2 | 10/2007 | |
| WO | WO 2007/112754 A2 | 10/2007 | |
| WO | WO 2007/134181 A2 | 11/2007 | |
| WO | WO 2007/146511 A2 | 12/2007 | |
| WO | WO 2008/025025 A2 | 2/2008 | |
| WO | WO 2008/034122 A2 | 3/2008 | |
| WO | WO 2008/034123 A2 | 3/2008 | |
| WO | WO 2008/046911 A2 | 4/2008 | |
| WO | WO 2008/053314 A2 | 5/2008 | |
| WO | WO 2008/057234 A2 | 5/2008 | |
| WO | WO 2008/061537 A2 | 5/2008 | |
| WO | WO 2008/074328 A2 | 6/2008 | |
| WO | WO 2008/091703 A2 | 7/2008 | |
| WO | WO 2008/113832 A2 | 9/2008 | |
| WO | WO 2008/124384 A2 | 10/2008 | |
| WO | WO 2008/150729 A2 | 12/2008 | |
| WO | WO 2008/154401 A2 | 12/2008 | |
| WO | WO 2009/020771 A2 | 2/2009 | |
| WO | WO 2009/043353 A2 | 4/2009 | |
| WO | WO 2009/032083 A1 | 12/2009 | |
| WO | WO 2010/012667 A2 | 4/2010 | |

OTHER PUBLICATIONS

Alvarez-Garcia, I. and Miska, E., "MicroRNA functions in animal development and human disease," *Development* 132:4653-4662, The Company of Biologists, Ltd., United Kingdom (2005).

Ambros, V., "The functions of animal microRNAs," *Nature* 431:350-355, Nature Publishing Group, United Kingdom (2004).

Bartel, D., "MicroRNAs: Genomics, Biogenesis, Mechanism, and Function," *Cell* 116:281-297, Cell Press, United States (2004).

Beaucage, L. and Iyer, R., "Advances in the Synthesis of Oligonucleotides by the Phosphoramidite Approach," *Tetrahedron* 48:2223-2311, Pergamon Press, United Kingdom (1992).

Beaucage, L. and Iyer, R., "The Synthesis of Modified Oligonucleotides by the Phosphoramidite Approach and Their Applications," *Tetrahedron* 49:6123-6194, Pergamon Press, United Kingdom (1993).

Bhat, B., et al., "2'-O-Methoxyethyl/2'-Fluoro Modified Oligonucleotides Result in More Potent Inhibition of micro RNA-122 in Vivo: A Target Implicated in HCV Replication," (Abstract) *Nucleic Acids Symposium Series* 52:69, Oxford University Press, Unitted Kingdom (2008).

Boehm, M., and Slack, F., "A Developmental Timing MicroRNA and Its Target Regulate Life Span in *C. elegans*," *Science* 310:1954-1957, American Assn. for the Advancement of Science, United States (2005).

Boutla, A., et al., "Developmental defects by antisense-mediated inactivation of micro-RNAs 2 and 13 in *Drosophila* and the identification of putative target genes," *Nucleic Acids Res.* 31:4973-4980, Oxford University Press, United Kingdom (2003).

Boutla, A., et al., "Short 5'-phosphorylated double-stranded RNAs induce RNA interference in *Drosophila*," *Curr. Biol.* 11:1776-1780, Cell Press, United States (2001).

Braasch, D., et al., "Antisense inhibition of gene expression in cells by oligonucleotides incorporating locked nucleic acids: effect of mRNA target sequence and chimera design," *Nucleic Acids Res.* 30:5160-5167, Oxford University Press, United Kingdom (2002).

Branch, A., and Rice, C., "Antisense Gets a Grip on miR-122 in Chimpanzees," *Sci. Transl. Med.* 2:1-4, American Assn. for the Advancement of Science, United States (2010).

Brennecke, J., et al., "*bantam* Encodes a Developmentally Regulated microRNA that Controls Cell Proliferation and Regulates the Proapoptotic Gene *hid* in *Drosophila*," *Cell* 113:25-36, Cell Press, United States (2003).

Brennecke, J., et al., "Principles of MicroRNA-Target Recognition," *PLoS Biology* 3:E85/0404-E85/0418, Public Library of Science, United States (2005).

Calin, G., et al., "Frequent deletions and down-regulation of micro-RNA genes *miR15* and *miR16* at 13q14 in chronic lymphocytic leukemia," *Proc. Natl. Acad. Sci. USA* 99:15524-15529, National Academy of Sciences, United States (2002).

Calin, G., et al., "Human microRNA genes are frequently located at fragile sites and genomic regions involved in cancers," *Proc. Natl. Acad. Sci. USA* 101:2999-3004, National Academy of Sciences, United States (2004).

Calin, G., et al., "A MicroRNA Signature Associated with Prognosis and Progression in Chronic Lymphocytic Leukemia," *N. Engl. J. Med.* 353:1793-1801, Massachusetts Medical Society, United States (2005).

Calin, G. and Croce, C., "MicroRNA signatures in human cancers," *Nat. Rev. Cancer* 6:857-866, Nature Publishing Group, United Kingdom (2006).

Chan, J., et al., "MicroRNA-21 Is an Antiapoptotic Factor in Human Glioblastoma Cells," *Cancer Res.* 65: 6029-6033, American Association for Cancer Research, United States (2005).

Chang, J., et al., "miR-122, a Mammalian Liver-Specific microRNA, is Processed from *hcr* mRNA and May Downregulate the High Affinity Cationic Amino Acid Transporter CAT-1," *RNA Biol.* 1:106-113, Landes Bioscience, United States (2004).

Chen, X., "A MicroRNA as a Translational Repressor of *APETALA2* in *Arabidopsis* Flower Development," *Science* 303:2022-2025, American Assn. for the Advancement of Science, United States (2004).

Chen, J.-F., et al., "The role of microRNA-1 and micro-RNA-133 in skeletal muscle proliferation and differentiation," *Nat. Genet.* 38:228-233, Nature Publishing Co., United States (2005).

Cheng, A., et al., "Antisense inhibition of human miRNAs and indications for an involvement of miRNA in cell growth and apoptosis," *Nucleic Acids Res.* 33:1290-1297, Oxford University Press, United Kingdom (2005).

Christensen, U. and Pedersen, E., "Intercalating nucleic acids containing insertions of 1-*O*-(1-pyrenylmethyl)glycerol: stabilisation of dsDNA and discrimination of DNA over RNA," *Nucleic Acids Res.* 30:4918-4925, Oxford University Press, United Kingdom (2002).

Corsten, M., et al., "MicroRNA-21 Knockdown Disrupts Glioma Growth In vivo and Displays Synergistic Cytotoxicity with Neural Precursor Cell-Delivered S-TRAIL in Human Gliomas," *Cancer Res.* 67:8994-9000, American Association for Cancer Research, United States (2007).

Crooke, R., "Chapter 3: In Vitro Cellular Uptake, Distribution, and Metabolism of Oligonucleotides," in *Antisense Research and Application* 131:103-140, Springer-Verlag, Germany (1998).

Czech, M., "MicroRNAs as Therapeutic Targets," *N. Engl. J. Med.* 354:1194-1195, Massachusetts Medical Society, United States (2006).

Dass, C., "Vehicles for oligonucleotide delivery to tumours," *J. Pharm. Pharmacol.* 54:3-27, Pharmaceutical Press, United Kingdom (2002).

Davidson, N. and Shelness, G., "Apolipoprotein B: mRNA Editing, Lipoprotein Assembly, and Presecretory Degradation," *Annu. Rev. Nutr.* 20:169-193, Annual Reviews, United States (2000).

Davis, S., et al., "Improved targeting of miRNA with antisense oligonucleotides," *Nucleic Acids Res.* 34:2294-2304, Oxford University Press, United Kingdom (2006).

Davis, S., et al., "Potent inhibition of microRNA in vivo without degradation," *Nucleic Acids Res.* 37:70-77, Oxford University Press, United Kingdom (2009).

Deere, J., et al., "Antisense Prosphorodiamidate Morpholino Oligomer Length and Target Position Effects on Gene-Specific Inhibition in *Eschericia coli,*" *Antimicrobal Agents and Chemotherapy* 49:249-255, American Society for Microbiology, United States (2005).

Eis, P., et al., "Accumulation of miR-155 and *BIC* RNA in human B cell lymphomas," *Proc. Natl. Acad. Sci. USA* 102: 3627-3632, National Academy of Sciences, United States (2005).

Eisenberg, I., et al., "Distinctive patterns of microRNA expression in primary muscular disorders," *Proc. Natl. Acad. Sci. USA* 104:17016-17021, National Academy of Sciences, United States (2007).

Elbashir, S., et al., "Analysis of gene function in somatic mammalian cells using small interfering RNAs," *Methods* 26:199-213, Academic Press, United States (2002).

Elmén, J., et al., "Locked nucleic acid containing antisense oligonucleotides enhance inhibition of HIV-1 genome dimerization and inhibit virus replication," *FEBS Letters* 578:285-290, Elsevier B.V., The Netherlands (2004).

Elmén, J., et al., "Antagonism of microRNA-122 in mice by systematically administered LNA-antimiR leads to up-regulation of a large set of predicted target mRNAs in the liver," *Nucleic Acids Res.* 36:1-10, Oxford University Press, United Kingdom (2007).

Elmén, J., et al., "LNA-antimiRs: Promising candidates for therapeutic intervention of disease-related microRNAs," [poster] 71st Symposium on Quantitative Biology; Regulatory RNAs, Cold Spring Harbor, New York, United States (May 2006).

Elmén, J., et al., "LNA-mediated microRNA silencing in non-human primates," *Nature* 452:896-900, Nature Publishing Group, United Kingdom (2008).

Elmén, J., et al., "LNA-mediated microRNA silencing in non-human primates," *Nature 45* [Supplementary Information], 33 pages, Nature Publishing Group, United Kingdom (2008).

Esau, C., "MicroRNA-143 Regulates Adipocyte Differentiation," *J. Biol. Chem.* 279:52361-52365, American Society for Biochemistry and Molecular Biology, United States (2004).

Esau, C., et al., "MicroRNA-143 Regulates Adipocyte Differentiation [Supplementary Methods]," *J. Biol. Chem. 279*, 25 pages, American Society for Biochemistry and Molecular Biology, United States (2004).

Esau, C., et al., "miR-122 regulation of lipid metabolism revealed by in vivo antisense targeting," *Cell Metab.* 3:87-98, Cell Press, United States (2006).

Esau, C., et al., "miR-122 regulation of lipid metabolism revealed by in vivo antisense targeting," [Supplemental data] *Cell Metab. 3*, 1 page, Cell Press, United States (2006).

Esau, C., "Inhibition of microRNA with antisense oligonucleotides," *Methods* 44:55-60, Academic Press, United States (2008).

Esquela-Kerscher, A. and Slack, F., "Oncomirs—microRNAs with a role in cancer," *Nat. Rev. Cancer* 6:259-269, Nature Publishing Group, United Kingdom (2006).

Fabani, M., and Gait, M., "miR-122 targeting with LNA/2′-*O*-methyl oligonucleotide mixmers, peptide nucleic acids (PNA), and PNA-peptide conjugates," *RNA* 14:336-346, Cold Spring Harbor Laboratory Press, United States (2008).

Feld, J., et al., "Ribavirin Improves Early Response to Peginterferon Through Improved Interferon signaling," *Gastroenterology* 139:154-162, W.B. Saunders, United States (2010).

Freier, S. and Altmann, K.-H., "The ups and downs of nucleic acid duplex stability: structure—stability studies on chemically-modified DNA: RNA duplexes," *Nucleic Acids Res.* 25:4429-4443, Oxford University Press, United Kingdom (1997).

Frieden, M., et al., "Expanding the design horizon of antisense oligonucleotides with alpha-L-LNA," *Nucleic Acids Res.* 31:6365-6372, Oxford University Press, United Kingdom (2003).

Gentleman, R., et al., "Bioconductor: open software development for computational biology and bioinformatics," *Genome Biol.* 5:R80, BioMed Central Ltd., United Kingdom (2004).

Giles, R., et al., "Selecting optimal oligonucleotide composition for maximal antisense effect following streptolysin O-mediated delivery into human leukaemia cells," *Nucleic Acid Res.* 26:1567-1575, Oxford University Press, United Kingdom (1998).

Giraldez, A., et al., "MicroRNAs Regulate Brain Morphogenesis in Zebrafish," *Science* 308: 833-838, American Assn. for the Advancement of Science, United States (2005).

Greene, T. and Wuts, P., *Protective Groups in Organic Synthesis*, [Table of Contents], 3rd ed., John Wiley & Sons, Chichester, England (1999).

Griffiths-Jones, S., "The microRNA Registry," *Nucleic Acids Res.* 32:D109-D111 (Database issue), Oxford University Press, United Kingdom (2004).

Griffiths-Jones, S., et al., "miRBase: microRNA sequences, targets and gene nomenclature," *Nucleic Acids Res.* 34:D140-D144 (Database issue), Oxford University Press, United Kingdom (2006).

Grimson, A., et al., "MicroRNA Targeting Specificity in Mammals: Determinants beyond Seed Pairing," *Mol. Cell.* 27:91-105, Elsevier, Inc., The Netherlands (2007).

Hanecak, R., et al., "Antisense Oligonucleotide Inhibition of Hepatitis C Virus Gene Expression in Transformed Hepatocytes," *J. Virol.* 70:5203-5212, American Society for Microbiology, United States (1996).

Haussecker, D. and Kay, M., "miR-122 Continues to Blaze the Trail for MicroRNA Therapeutics," *Molecular Therapy* 18:240-242, Nature Publishing Group, United States (2010).

He, L., et al., "A microRNA polycistron as a potential human oncogene," *Nature* 435:828-833, Nature Publishing Group, United Kingdom (2005).

Heid, C., et al., "Real Time Quantitative PCR," *Genome Res.* 6:986-994, Cold Spring Harbor Laboratory Press, United States (1996).

Hornstein, E., et al., "The microRNA *miR-196* acts upstream of Hoxb8 and Shh in limb development," *Nature* 438:671-674, Nature Publishing Group, United Kingdom (2005).

Hu, Q., "Subcellular trafficking of antisesnse oligonucleotides and down-regulation of *bcl-2* gene expression in human melanoma cells using a fusogenic liposome delivery system," *Nucleic Acid Res.* 30:3632-3641, Oxford University Press, United Kingdom (2002).

Huang, H., et al., "Hepatitis C virus production by human hepatocytes dependent on assembly and secretion of very low-density lipoproteins," *Proc. Natl. Acad. Sci. U.S.A.* 104:5848-5853, National Academy of Sciences, United States (2007).

Huber, W., et al., "Variance stabilization applied to microarray data calibration and to the quantification of differential expression," *Bioinformatics* 18:S96-S104, Oxford University Press, United Kingdom (2002).

Hutton, J., "Renaturation kinetics and thermal stability of DNA in aqueous solutions of form amide and urea," *Nucleic Acids Res.* 4:3537-3555, Oxford University Press, United Kingdom (1977).

Hutvágner, G., et al., "A Cellular Function for the RNA-Interference Enzyme Dicer in the Maturation of the *let-7* Small Temporal RNA," *Science* 293:834-838, American Assn. for the Advancement of Science, United States (2001).

Hutvágner, G., et al., "Sequence-Specific Inihibition of Small RNA Function," *PLoS Biology* 2:0465-0475, Public Library of Science, United States (2004).

Hwang, H., et al., "Cell—cell contact globally activates microRNA biogeneis," *Proc. Natl. Acad. Sci.* 106:7016-7021, National Academy of Sciences, United States (2009).

Iorio, M., et al., "MicroRNA Gene Expression Deregulation in Human Breast Cancer," *Cancer Res.* 65:7065-7070, American Assn. for Cancer Research, United States (2005).

Ittig, D., et al., "Nuclear antisense effects in cyclophilin A pre-mRNA splicing by oligonucleotides: a comparison of tricyclo-DNA with LNA," *Nucleic Acids Res.* 32:346-353, Oxford University Press (2004).

Jackson, A. and Linsley, P., "The Therapeutic Potential of microRNA Modulation," discoverymedicine.com, assessed at http://www.discoverymedicine.com/Aimee-Jackson/2010/04/10/the-therapeutic-potential-of-microrna-modulation/, assesed on May 5, 2010, 7 pages.

Jepsen, J., et al., "Locked Nucleic Acid: A Potent Nucleic Acid Analog in Therapeutics and Biotechnology," *Oligonucleotides* 14:130-146, Mary Ann Liebert, Inc., United States (2004).

Jin, P., et al., "RNA and microRNAs in fragile X mental retardation," *Nat. Cell Biol.* 6:1048-1053, Nature Publishing Group, United States (2004).

Johansson, H., et al., "Target-specific arrest of mRNA translation by antisense 2'-O-alkyloligonucleotides," *Nucleic Acids Res.* 22: 4591-4598, Oxford University Press, United Kingdom (1994).

Johnson, S., et al., "*RAS* Is Regulated by the *let-7* MicroRNA Family," *Cell* 120:635-647, Cell Press, United States (2005).

Johnston, Jr., R., and Hobert, O., "A microRNA controlling left/right neuronal asymmetry in *Caenorhabditis elegans*," *Nature* 426:845-849, Nature Publishing Group, United Kingdom (2003).

Jopling, C., et al., "Modulation of Hepatitis C Virus RNA Abundance by a Liver-Specific MicroRNA," *Science* 309:1577-1571, American Assn. for the Advancement of Science, United States (2005).

Jopling, C., et al., "Liver-specific microRNA122 Regulates Hepatitis C Viral RNA Abundance," p. 124, Sarnow, P. Conference: Translational Control, Cold Spring Harbor Laboratory, Cold Spring Harbor, New York, United States, Sep. 7-12, 2004.

Kauppinen, S., et al., "Locked nucleic acid (LNA): High affinity targeting of RNA for diagnostics and therapeutics," *Drug Discovery Today: Technologies* 2:287-290, Elsevier, Ltd., The Netherlands (2005).

Ketting, R., et al., "Dicer functions in RNA interference and in synthesis of small RNA involved in developmental timing in *C.elegans*," *Genes Dev.* 15:2654-2659, Cold Spring Harbor Laboratory Press, United States (2001).

Kloosterman, W., et al., "Substrate requirements for *let-7* function in the developing zebrafish embryo," *Nucleic Acids Res.* 32:6284-6291, Oxford University Press, United Kingdom (2004).

Kloosterman, W. and Plasterk, R., "The Diverse Functions of MicroRNAs in Animal Development and Disease," *Dev. Cell* 11:441-450, Elsevier, Inc., The Netherlands (2006).

Kloosterman, W., et al., "In situ detection of miRNAs in animal embryos using LNA-modified oligonucleotide probe," *Nat. Methods* 3:27-29, Nature Publishing Group, United States (2006).

Kocerha, J., et al., "MicroRNA-219 modulates NMDA receptor-mediated neurobehavioral dysfunction," *Proc. Natl. Acad. Sci. USA* 106:3507-3512, National Academy of Sciences, United States (2008).

Krukemeyer, M., et al., "Description of B lymphocytes and plasma cells, complement, and chemokines/receptors in acute liver allograft rejection," *Transplantation* 78:65-70, Lippincott Williams & Wilkins, United States (2004).

Krützfeldt, J., et al., Silencing of microRNAs in vivo with 'antagomirs,' Nature Letters 438:685-689, Nature Publishing Group, United Kingdom (2005).

Krützfeldt, J., et al., Specificity, duplex degradation and subcellular localization of antagomirs, *Nucleic Acids Res.* 35:2885-2892, Oxford University Press, United Kingdom (2007).

Kurreck, J., et al., "Design of antisense oligonucleotides stabilized by locked nucleic acids," *Nucleic Acids Res.* 30:1911-1918, Oxford University Press, United Kingdom (2002).

Kwon, C., et al., "MicroRNA1 influences cardiac differentiation in *Drosophila* and regulates Notch signaling," *Proc. Natl. Acad. Sci. USA* 102:18986-18991, National Academy of Sciences, United States (2005).

Lagos-Quintana, M., et al., "Identification of Tissue-Specific MicroRNAs from Mouse," *Curr. Biol.* 12:735-739, Elsevier Science Ltd., The Netherlands (2002).

Landthaler, M., et al., "The Human DiGeorge Syndrome Critical Region Gene 8 and Its *D. melanogaster* Homolog Are Required for miRNA Biogenesis," *Curr. Biol.* 14:2162-2167, Elsevier Ltd., The Netherlands (2004).

Lanford, R., et al., "Antiviral Effect and Virus-Host Interactions in Response to Alpha Interferon, Gamma Interferon, Poly(I)-poly(C), Tumor Necrosis Factor Alpha, and Ribavirin in Hepatitis C Virus Subgenomic Replicons," *J. Virol.* 77:1092-1104, American Society for Microbiology, United States (2003).

Lanford, R., et al., "Lack of response to exogenous interferon-alpha in the liver of chimpanzees chronically infected with hepatitis C virus," *Hepatology* 46:999-1008, Wiley, United States (2007).

Lanford, R., et al., "Therapeutic Silencing of MicroRNA-122 in Primates with Chronic Hepatitis C Virus Infection," *Science* 327:198-201, American Assn. for the Advancement of Science, United States (2010); published online Science Express on Dec. 3, 2009 (10.1126/science.117817).

Leaman, D., et al., "Antisense-Mediated Depletion Reveals Essential and Specific Functions of MicroRNAs in *Drosophila* Development," *Cell* 121:1097-1108, Cell Press, United States (2005).

Lecellier, C.-H., et al., "A Cellular MicroRNA Mediates Antiviral Defense in Human Cells," *Science* 308:557-560, American Assn. for the Advancement of Science, United States (2005).

Lecellier, C.-H., et al., "A Cellular MicroRNA Mediates Antiviral Defense in Human Cells," [Supporting online material] *Science* 308:557-560, American Assn. for the Advancement of Science, United States (2005).

Lee, Y., et al., "The nuclear RNase III Drosha initiates microRNA processing," *Nature* 425:415-419, Nature Publishing Group, United Kingdom (2003).

Lee, Y., et al., "Depletion of Human Micro-RNA miR-125b Reveals That It Is Critical for the Proliferation of Differentiated Cells but Not for the Down-regulation of Putative Targets during Differentiation," *J. Biol. Chem.* 280:16635-16641, The American Society for Biochemistry and Molecular Biology, Inc., United Staes (2005).

Lewis, B., et al., "Conserved Seed Pairing, Often Flanked by Adenosines, Indicates that Thousands of Human Genes are MicroRNA Targets," *Cell* 120:15-20, Elsevier, Inc., The Netherlands (2005).

Li, X. and Carthew, R., "A microRNA Mediates EGF Receptor Signaling and Promotes Photoreceptor Differentiation in the *Drosophila* Eye," *Cell* 123:1267-1277, Elsevier, Inc., The Netherlands (2005).

Lim, L., et al., "Microarray analysis shows that some microRNAs downregulate large numbers of target mRNAs," *Nature* 433:769-773, Nature Publishing Group, United Kingdom (2005).

Lima, W., et al., "Combinatorial Screening and Rational Optimization for Hybridization to Folded Hepatitis C Virus RNA of Oligonucleotides with Biological Antisense Activity," *J. Biol. Chem.* 272:626-638, The American Society for Biochemistry and Molecular Biology, United States (1997).

Lisziewicz, J., et al., "Long-term treatment of human immunodeficiency virus-infected cells with antisense oligonucleotide phosphorothioates," *Proc. Natl. Acad. Sci.* 90:3860-3864, National Academy of Sciences, United States (1993).

Liu, J., et al., "The microRNAs of *Caenorhabditis elegans*," [powerpoint slides], 36 slides, Sep. 22, 2004.

Lu, J., et al., "MicroRNA expression profiles classify human cancers," *Nature* 435:834-838, Nature Publishing Group, United Kingdom (2005).

Manoharan, M., et al., "Novel Functionalization of the Sugar Moiety of Nucleic Acids for Multiple Labeling in the Minor Groove," *Tetrahedron Letters* 34:7171-7174, Pergamon Press, PLC., United Kingdom (1991).

Martinez, J., et al., Single-Stranded Antisense siRNAs Guide Target RNA Cleavage in RNAi, *Cell* 110:563-574, Cell Press, United States (2002).

Matz, M., et al., "Early post-transplant urinary IP-10 expression after kidney transplantation is predictive of short- and long-term graft function," *Kidney Int.* 69:1683-1690, Nature Publishing Group (2006).

McManus, M., and Sharp, P., "Gene Silencing in Mammals by Small Interfering RNAs," *Nat. Rev. Genet.* 3:737-747, Nature Publishing Group, United Kingdom (2002).

Michael, M., et al., "Reduced Accumulation of Specific MicroRNAs in Colorectal Neoplasia," *Mol. Cancer Res.* 1:882-891, American Association for Cancer Research, United States (2003).

Möröy, T., et al., "Structure and expression of *hcr*, a locus rearranged with *c-myc* in a woodchuck hepatocellular carcinoma," *Oncogene* 4:59-65, Nature Publishing Group, United Kingdom (1989).

Mourelatos, Z., et al., "miRNPs: a novel class of ribonucleoproteins containing numerous microRNAs," *Genes Dev.* 16:720-728, Cold Spring Harbor Laboratory Press, United States (2002).

Naguibneva, I., et al., "The microRNA *miR-181* targets the homeobox protein Hox-A11 during mammalian myoblast differentiation," *Nature Cell Biol.* 8:278-284, Nature Publishing Group, United States (2006).

Naguibneva, I., et al., "The microRNA *miR-181* targets the homeobox protein Hox-A11 during mammalian myoblast differentiation," *Nature Cell Biol.* 8 [Supplementary Information], Nature Publishing Group, United States (2006).

Nelson, P., "The microRNA world: small is mighty," *Trends in Biochem. Sci.* 28:534-540, Elsevier Ltd., United Kingdom (2003).

Neuman, B., et al., "Antisense Morpholino-Oligomers Directed against the 5' End of the Genome Inhibit Coronavirus Proliferation and Growth," *J. Virol.* 78:5891-5899, American Society for Microbiology, United States (2004).

Norman, K., and Sarnow, P., "Hepatitis C virus' Achilles' heel-dependence on liver-specififc microRNA miR-122," *Cell Res.* 20:247-249, Nature Publishing Group, United Kingdom (2010).

Nulf, C. and Corey, D., "Intracellular inhibition of hepatitis C virus (HCV) internal ribosomal entry site (IRES)-dependent translation by peptide nucleic acids (PNAs) and locked nucleic acids (LNAs)," *Nucleic Acids Res.* 32:3792-3798, Oxford University Press, United Kingdom (2004).

Obad, S., et al., "Targeting of cancer-associated microRNAs using short LNA-antimiR oligonucleotides," *European Journal of Cancer Supplements* 6:142, 20th Meeting of the European Association for Cancer Research, Jul. 5-8, 2008, Lyon, France.

Ørom, U., et al., "LNA-modified oligonucleotides mediate specific inhibition of microRNA function," *Gene* 372:137-141, Elsevier, Inc., The Netherlands (2006).

Ouellet, D., of al., "MicroRNAs in Gene Regulation: When the Smallest Governs It All," Article ID 69616, *Journal of Biomedicine and Biotechnology* 2006:1-20, Hindawi Publishing Corporation, United States (2006).

Paushkin, S., et al., "The SMN complex, an assemblyosome of ribonucleoproteins," *Curr. Opin. Cell Biol.* 14:305-312, Elsevier Science Ltd., United Kingdom (2002).

Pedersen, D., et al., "Preparation of LNA Phosphoramidites," *Synthesis* 6:802-808, Thieme/Academic Press, Germany (2002).

Pedersen, D., and Koch, T., "Analogues of LNA (Locked Nucleic Acid). Synthesis of the 2'Thio-LNA Thymine and 5-Methyl Cytosine Phosphoramidites," *Synthesis* 4:578-582, Thieme/Academic Press, Germany (2003).

Pedersen, I., et al., "Interferon modulation of cellular microRNAs as an antiviral mechanism," *Nature* 449:919-922, Nature Publishing Group, United Kingdom (2007).

Petri, A., et al., "MicroRNA Silencing in Primates: Towards Development of Novel Therapeutics," *Can Res.* 69:393-395, American Association for Cancer Research, United States (2009).

Poy, M., "A pancreatic islet-specific microRNA regulates insulin secretion," *Nature* 432:226-230, Nature Publishing Group, United Kingdom (2004).

Prakash, T., et al., "Antisense Oligonucleotides Containing Conformationally Constrained 2',4'-(*N*-Methoxy)aminomethylene and 2',4'-Aminooxymethylene and 2'-O,4'-C-Aminomethylene Bridged Nucleoside Analogues Show Improved Potency in Animal Models," *J. Med. Chem.* 53:1636-1650, American Chemical Society, United States (2010).

Randall, G., et al., "Cellular cofactors affecting hepatitis C virus infection and replication," *Proc. Natl. Acad. Sci. USA* 104:12884-12889, National Academy of Sciences, United States (2007).

Rosenbohm, C., et al., "Synthesis of 2'-amino-LNA: a new strategy," *Org. Biomol. Chem.* 1:655-663, Royal Society of Chemistry, United Kingdom (2003).

Saeed, A., et al., "TM4: A Free, Open-Source System for Microarray Data Management and Analysis," *BioTechniques* 34:374-378, Informa Healthcare USA, Inc., United Kingdom (2003).

Samuel, D., "Hepatitis C, Interferon, and Risk of Rejection After Liver Transplantation," *Liver Transpl.* 10:868-887, Wiley InterScience, United States (2004).

Santaris Pharma, Nature Genetics Ad, Jun. 2006 [powerpoint slide], 1 page.

Sazani, P., et al., "Nuclear antisense effects of neutral, anionic and cationic oligonucleotide analogs," *Nucelic Acids. Res.* 29:3965-3974, Oxford University Press, United Kingdom (2001).

Schwarz, D., et al., "Evidence that siRNAs Function as Guides, Not Primers, in the *Drosophila* and Human RNAi Pathways," *Mol. Cell* 10:537-548, Cell Press, United States (2002).

Seth, P., et al., "Synthesis and Biophysical Evaluation of 2',4'-Constrained 2'O-Methoxyethyl and 2',4'-Constrained 2'O-Ethyl Nucleic Acid Analogues," *J. Org. Chem.* 75:1569-1581, American Chemical Society, United States (2010).

Shan, Y., et al., "Reciprocal Effects of Micro-RNA-122 on Expression of Heme Oxygenase-1 and Hepatitis C Virus Genes in Human Hepatocytes," *Gastroenterology* 133:1166-1174, W.B. Saunders, United States (2007).

Singh, S. and Wengel, J., "Synthesis of Novel Bicyclo[2.2.1] Ribonucleosides: 2'-Amino- and 2'-Thio-LNA Monomeric Nucleosides," *J. Org. Chem.* 63:6078-6079, American Chemical Society, United States (1998).

Soifer, H., et al., "MicroRNAs in Disease and Potential Therapeutic Applications," *Mol. Ther.* 15:2070-2079, The American Society of Gene Therapy, United States (2007).

Sokol, N. and Ambros, V., "Mesodermally expressed *Drosophila* microRNA-1 is regulated by Twist and is required in muscles during larval growth," *Gene Dev.* 19:2343-2354, Cold Spring Harbor Laboratory Press, United States (2005).

Sørensen, M., et al., "α-L-*ribo*-Configured Locked Nucleic Acid (α-L-LNA): Synthesis and Properties," *J. Am. Chem. Soc.* 124:2164-2176, American Chemical Society, United States (2002).

Stark, A., et al., "Identification of *Drosophila* MicroRNA Targets," *PLoS Biology* 1:397-409, Academic Press, United States (2003).

Tallet-Lopez, B., et al., "Antisense oligonucleotides targeted to the domain IIId of the hepatitis C virus IRES compete with 40S ribosomal subunit binding and prevent in vitro translation," *Nucleic Acids Res.* 31:734-742, Oxford University Press, United Kingdom (2003).

Tam, W., "Identification and characterization of human *BIC*, a gene on chromosome 21 that encodes a noncoding RNA," *Gene* 274:157-167, Elsevier, The Netherlands (2001).

Tijsterman, M., et al., "RNA Helicase MUT-14-Depedent Gene Silencing Triggered in *C. elegans* by Short Antisense RNAs," *Science* 295:694-697, American Assn. for the Advancement of Science, United States (2002).

Triboulet, R., et al., "Suppression of MicroRNA-Silencing Pathway by HIV-1 During Virus Replication," *Science* 315:1579-1582, American Assn. for the Advancement of Science, United States (2007).

Tsuchiya, Y., et al., "MicroRNA Regulates the Expression of Human Cytochrome P450 1B1," *Cancer Res.* 66:9090-9098, American Association for Cancer Research, United States (2006).

Uhlmann, E., "Recent advances in the medicinal chemistry of antisense oligonucleotides," *Curr. Opin. Drug Discov. Develop.* 3:203-213, Pharma Press Ltd., United Kingdom (2000).

Válóczi, A., et al., "Sensitive and specific detection of microRNAs by northern blot analysis using LNA-modified oligonucleotide probes," *Nucleic Acids Res.* 32:e175, Oxford University Press, United Kingdom (2004).

van Rooij, E., et al., "Control of Stress-Dependent Cardiac Growth and Gene Expression by a MicroRNA," *Science* 316:575-579, American Assn. for the Advancement of Science, United States(2007).

Wagner, R., "Gene inhibition using antisense oligodeoxynucleotides," *Nature* 372:333-335, Nature Publishing Group, United Kingdom (1994).

Wagner, R., et al., "Potent and selective inhibition of gene expression by an antisense heptanucleotide," *Nat. Biotechnol.* 14:840-844, Nature Publishing Group, United States (1996).

Wahlestedt, C., et al., "Potent and nontoxic antisense oligonucleotides containing locked nucleic acids," *Proc. Natl. Acad. Sci. USA* 97:5633-5638, National Academy of the Sciences, United States (2000).

Walter, T., et al., "Rejection Under Alpha Interferon Therapy in Liver Transplant Recipients," *American Journal of Transplantation* 7:177-184, Blackwell Munksgaard, Denmark (2007).

Weiler, J., et al., "Anti-miRNA oligonucleotides (AMOs): ammunition to target miRNAs implicated in human disease?" *Gene Ther.* 13:496-502, Nature Publishing Group, United Kingdom (2006).

Weinholds, E., et al., "MicroRNA Expression in Zebrafish Embryonic Development," *Science* 309:310-311, American Assn. for the Advancement of Science, United States (2005).

Worm, J., et al., "Silencing of microRNA-155 in mice during acute inflammatory response leads to derepression of c/ebp Beta and down-regulation of G-CSF," *Nucleic Acids Res.* 37:5784-5792, Oxford University Press, United Kingdom (2009).

Yang, B., et al., "The muscle-specific microRNA *miR-1* regulates cardiac arrhythmogenic potential by targeting *GJA1* and *KCNJ2*," *Nat. Med.* 13:486-491, Nature Publishing Company, United States (2007).

Yekta, S., et al., "MicroRNA-Directed Cleavage of *HOXB8* mRNA," *Science* 304:594-596, American Assn. for the Advancement of Science, United States (2004).

Yu, J., et al.., "RNA interference by expression of short-interfering RNAs and hairpin RNAs in mammalian cells," *Proc. Natl. Acad. Sci.* 99:6047-6052, National Academy of Sciences, United States (2002).

Zhang, H., et al., "Antisense Oligonucleotide Inhibition of Hepatisis C Virus (HCV) Gene Expression in Livers of Mice Infected with an HCV-Vaccinia Virus Recombinant," *Antimicrobial Agents and Chemotherapy* 43:347-353, American Society for Microbiology, United States (1999)

Zhao, Y., et al., "Serum response factor regulates a muscle-specific microRNA that targets *Hand2* during cardiogenesis," *Nature* 436:214-220, Nature Publishing Group, United Kingdom (2005).

International Search Report for International Application No. PCT/DK2007/000168, European Patent Office, mailed on Jan. 28, 2008.

International Search Report for International Application No. PCT/DK2008/000345, European Patent Office, mailed on Oct. 7, 2009.

The Written Opinion of the International Searching Authority for International Application No. PCT/DK2008/000345, European Patent Office, mailed on Oct. 7, 2009.

International Search Report for International Application No. PCT/DK2008/000344, European Patent Office, mailed on Oct. 7, 2009.

International Search Report for International Application No. PCT/EP2009/052728, European Patent Office, mailed on Jul. 31, 2009.

International Search Report for International Application No. PCT/DK2007/000169, European Patent Office, mailed on Jul. 3, 2008.

Office Action mailed on Jul. 13, 2010 in U.S. Appl. No. 12/296,084, inventors Elmen et al., filed Sep. 10, 2009.

Agrawal, S. and Zhao, Q., "Antisense therapeutics," *Curr. Opin. Chem. Biol.* 2:519-528, Elsevier, United Kingdom (1998).

Agrawal, S., et al., "Mixed-backbone oligonucleotides as second generation antisense oligonucleotides: In vitro and in vivo studies," *Proc. Natl. Acad. Sci. USA* 94:2620-2625, National Academy of Sciences, United States (1997).

Agrawal, S., et al., "Pharmacokinetics, biodistribution, and stability of oligodeoxynucleotide phosphorothioates in mice," *Proc. Natl. Acad. Sci. USA* 88:7595-7599, National Academy of Sciences, United States (1991).

Agrawal, S., "Importance of nucleotide sequence and chemical modifications of antisense oligonucleotides," *Biochim. Biophys. Acta* 1489:53-68, Elsevier, Netherlands (1999).

Akhtar, S., "Antisense Technology:Selection and delivery of optimally acting antisense oligonucleotides," *J. Drug Target.* 5:225-234, Informa Healthcare, United States (1998).

Ameres, S., et al., "Molecular Basis for Target RNA Recognition and Cleavage by Human RISC," *Cell* 130:101-112, Cell Press, United States (2007).

Asangani, I., et al., "MicroRNA-21 (miR-21) post-transcriptionally downregulates tumor suppressor Pdcd4 and stimulates invasion, intravasation and metastasis in colorectal cancer," *Oncogene* 27:2128-2136, Nature Publishing Group, United Kingdom (2008).

Bai, S., et al., "MicroRNA-122 inhibits tumorigenic Properties of Hepatocellular Carcinoma Cells and Sensitizes These Cells to Sorafenib," *J. Biol.Chem.* 284:32015-32027, American Society for Biochemistry and Molecular Biology, United States (2009).

Bartenschlager, R. and Pietschmann, T., "Efficient hepatitis C virus cell culture system: What a difference the host cell makes," *Proc. Natl. Acad. Sci. USA* 102:9739-9740, National Academy of Sciences, United States (2005).

Bartosch, B., et al., "Cell Entry of Hepatitis C Virus Requires a Set of Co-receptors That Include the CD81 Tetraspanin and the Sr-Bl Scavenger Receptor," *J. Biol. Chem.* 278:41624-41630, American Society for Biochemistry and Molecular Biology, United States (2003).

Bennett, C., "MicroRNAs as therapeutic targets," Abstracts of Papers, 234th ACS National Meeting, CARB-047, Database: CAPLUS (2007), Boston, MA, United States, Aug. 19-23, 2007.

Bennett, C., et al., "Antisense Oligonucleotide-based Therapeutics," in *Gene and Cell Therapy*, 2nd Ed., pp. 347-374, Templeton, N., ed., Marcel Dekker, Inc., United States (2004).

Branch, A., "A good antisense molecule is hard to find," *Trends Biochem. Sci.* 23:45-50, Elsevier Trends Journals, United Kingdom (1998).

Chang, J., et al., "Liver-Specific MicroRNA miR-122 Enhances the Replication of Hepatitis C Virus in Nonhepatic Cells," *J. Virol.* 82:8215-8223, American Society for Microbiology, United States (2008).

Choi, W., et al., "Target Protectors Reveal Dampening and Balancing of Nodal Agonist and Antagonist by miR-430," *Science* 318:271-274, American Association for the Advancement of Science, United States (2007).

Connolly, E., et al., "Elevated Expression of the miR-17-92 Polycistron and miR-21 in Hepadnavirus-Associated Hepatocellular Carcinoma Contributes to the Malignant Phenotype," *Am. J. Pathol.* 173:856-864, American Society for Investigative Pathology, United States (2008).

Cook, P., "Antisense Medicinal Chemistry," in *Antisense Research & Application*, Crooke, S., ed., vol. 131, pp. 51-101, Springer-Verlag, Germany (1998).

Coulouarn, C., et al., "Loss of miR-122 expression in liver cancer correlates with suppression of the hepatic phenotype and gain of metastatic properties," *Oncogene* 28:3526-36, Nature Publishing Group, United Kingdom (2009).

Crooke, S., "Mechanisms of Antisense Drug Action, an Introduction," in *Antisense Drug Technology, Principles, Strategies and Applications*, Crooke, S., ed., pp. 3-46, Taylor & Francis LLC, United Kingdom (2008).

Crooke, S., "An overview of Progress in Antisense Therapeutics," *Antisense & Nucleic Acid Drug Development* 8:115-122, Mary Ann Liebert, Inc., United States (1998).

Crooke, S., "Basic Principles of Antisense Technology," in Antisense Drug Technology, Principles, Strategies and Applications, Crooke, S., ed, pp. 1-28, Marcel Dekker, Inc., NY, United States (2001).

Davis, S., et al., "Potent inhibition of microRNA in vivo without degradation," *Nucleic Acids Res.* 37:70-77, Oxford University Press, United Kingdom (2008) [Supplementary data].

D. Young & Co., Investigation of teachings of WO2008/061537 and WO2008/151639, Jan. 2009, 22 pages.

Díaz-Toledano, R., et al., "In vitro characterization of a miR-122-sensitive double-helical switch element in the 5' region of hepatitis C virus RNA," *Nucl. Acids Res.* 37:5498-5510, Oxford University Press, United Kingdom (2009).

Elmén, J., et aL, "LNA-antimiRs: Promising candidates for therapeutic intervention of disease-related microRNAs," [Presentation abstract] 71st Symposium on Quantitative Biology: Regulatory RNAs, Cold Spring Harbor, NY, United States, May 31-Jun. 5, 2006, 1 page.

Elmén, J., et al., "Lna-antimiRs: Promising candidates for therapeutic intervention of disease-related microRNAs," [Conference abstract] Nov. 1-2, 2006, MicroRNAs: Biology to Development and Disease, Peterhouse, University of Cambridge, United Kingdom (2006), 1 page.

Esau, C., et al., "Identification of microRNAs involved in adipocyte development using second-generation antisense oligonucleotides in an in vitro adipocyte differentiation model," [Poster abstract] siRNAs and miRNAs Keystone Symposium, Keystone Resort, Colorado, United States, Apr. 14-19, 2004, 1 page.

Esau, C. and Monia, B., "Therapeutic potential for microRNAs," *Adv. Drug Deliv. Rev.* 59:101-114, Elsevier Science Publishers, B.V., Netherlands (2007).

U.S. Department of Health and Human Services, Food and Drug Administration, Center for Drug Evaluation and Research (CDER), "Guidance for Industry Antiviral Product Development—Conducting and Submitting Virology Studies to the Agency," Jun. 2006, Clinical Antimicrobial, 17 pages.

Feld, J. and Hoofnagle, J., "Mechanism of action of interferon and ribavirin in treatment of hepatitis C," *Nature* 436:967-72, Nature Publishing Group, United Kingdom (2005).

Fluiter, K., et aL, "In vivo tumor growth inhibition and biodistribution studies of locked nucleic acid (LNA) antisense oligonucleotides," *Nucleic Acids Res.* 31:953-962, Oxford University Press, United Kingdom (2003).

Fornari, F., et al., "MiR-122/Cyclin G1 Interaction Modulates p53 Activity and Affects Doxorubicin Sensitivity of Human Hepatocarcinoma Cells," *Cancer Res.* 69:5761-5767, American Association for Cancer Research, United States (2009).

Frankel, L., et al., "Programmed cell death 4 (PDCD4) is an important functional target of the microRNA miR-21 in breast cancer cells," *J. Biol. Chem.* 283:1026-1033, The American Society for Biochemistry and Molecular Biology, United States (2008).

Freier, S., "Methods of Selecting Sites in RNA for Antisense Targeting," Antisense Drug Technology, Crooke, S., ed., CRC Press, United States (2001).

Frieden, M. and Ørum, H., "Locked Nucleic Acid Holds Promise in the Treatment of Cancer," *Curr. Pharmac. Design* 14:1138-1142, Bentham Science Publishers, Netherlands (2008).

Gabriely, G., et al., "MicroRNA 21 Promotes Glioma Invasion by Targeting Matrix Metalloproteinase Regulators," *Molec. Cell. Biol.* 28:5369-5380, American Society for Microbiology, United States (2008).

Galardi, S., et al., "miR-221 and miR-222 expression affects the proliferation potential of human prostate carcinoma cell lines by targeting p27Kip1," *J. Biol. Chem.* 282:23716-23724, The American Society for Biochemistry and Molecular Biology, United States (2007).

Geary, R., et aL, "Pharmacokinetic Properties of 29-O-(2-Methoxyethyl)-Modified Oligonucleotide Analogs in Rats," *J. Pharm. Exper. Therap.* 296:890-897, American Society for Pharmacology and Experimental Therapeutics, United States (2001).

Gerwitz, A., "Nucleic Acid Therapeutics: State of the art and future prospects," *Blood* 92:712-736, American Society of Hematology, United States (1998).

Girard, M., et al., "miR-122, a paradigm for the role of microRNAs in the liver," *J. Hepatol.* 48:648-656, Elsevier, United Kingdom (2008).

Gramantieri, L., et al., "Cyclin G1 is a Target of miR-122a, a MicroRNA Frequently Down-regulated in Human Hepatocellular Carcinoma," *Cancer Res.* 64:6092-6099, American Association for Cancer Research, United States (2007).

Grimm, D. and Kay, M., "Therapeutic application of RNAi: is mRNA targeting finally ready for prime time?," *J. Clinic. Invest.* 117:3633-3641, American Society for Clinical Investigation, United States (2007).

Henke, J., et al., "microRNA-122 stimulates translation of hepatitis C virus RNA," *EMBO Journal* 27:3300-3310, Nature Publishing Group, United Kingdom (2008).

Hildebrandt-Eriksen, E., et al., "A unique Therapy for HCV Inhibits microRNA-122 in Humans and Results in HCV Suppression in Chronically Infected Chimpanzees: Results from Primate and First-in-Human Studies," *Hepatology* LB19, 50:12A, Wiley, United States (2009).

Hogrefe, R., "An antisense oligonucleotide primer," *Antisense Nucleic Acid Drug Dev.* 9:351-357, Mary Ann Liebert, Inc., United States (1999).

Horwich, M. and Zamore, P., "Design and delivery of antisense oligonucleotides to block microRNA function in cultured *Drosophila* and human cells," *Nature Protocols* 3:1537-1549, Nature Publishing Group, United Kingdom (2008).

Hutvagner, G., et al., "Sequence-specific inhibition of small RNA function," [Poster abstract] siRNAs and miRNAs Keystone Symposium, Keystone Resort, Apr. 14-19, 2004, Colorado, United States, 1 page.

Ikeda, M., et al., "Selectable Subgenomic and Genome-Length Dicistronic RNAs Derived from an Infectious Molecular Clone of the HCV-N Strain of Hepatitis C Virus Replicate Efficiently in Cultured Huh7 Cells," *J. Virol.* 76:2997-3006, American Society for Microbiology, United States (2002).

Iliopoulos, D., et al., "MicroRNA-370 controls the expression of MicroRNA-122 and Cptlα and affects lipid metabolism," *J. Lipid Res.* 51:1513-1523, American Society for Biochemistry and Molecular Biology, United States (2010).

Jepsen, J. and Wengel, J., "LNA-Antisense rivals siRNA for gene silencing," *Curr. Opin. Drug Discov. Develop.* 7:1889-1894, Thomson Reuters (Scientific) Ltd., United Kingdom (2004).

Johnson, C.D., et al., "The let-7 MicroRNA Represses Cell Proliferation Pathways in Human Cells," *Cancer Res.* 67:7713-7722, American Association for Cancer Research, United States (2007).

Jopling, C., "Regulation of hepatitis C virus by microRNA-122," *Biochem. Soc. Trans.* 36:1220-1223, Portland Press, United Kingdom (2008).

Jopling, C., et al., "Positive and negative Modulation of Viral and Cellular mRNAs by liver-specific MicroRNA miR-122," Cold Spring Harbor Symposia on Quantitative Biology, vol. 71, pp. 369-376, Cold Spring Laboratory Press, United States, May 31-Jun. 5, 2006.

Jopling, C., "Position-Dependent Function for a Tandem MicroRNA miR-122-Binding Site Located in the Hepatitis C Virus RNA Genome," *Cell Host and Microbe* 4:77-85, Cell Press, United States (2008).

Kauppinen, S., "Antagonizing microRNAs for therapeutics," *Hum. Gene Ther.* 19:1063, M.A. Liebert, United States (2008).

Kauppinen, S., et al., "Locked Nucleic Acid: High-Affinity Targeting of Complementary RNA for RNomics," in *Handbook of Experimental Pharmacology*, vol. 173, pp. 405-422, Springer-Verlag, Berlin, Germany (2006).

Kaur, H., et al., "LNA-modified olig onucleotides effectively drive intramolecular-stable hairpin to intermolecular-duplex state," *Biochem. Biophys. Res. Comm.* 352:118-122, Academic Press, United States (2007).

Khan, A., et al., "Transfection of small RNAs globally perturbs gene regulation by endogenous microRNAs," *Nat. Biotechnol.* 27:549-555, Nature Publishing Group, United States (2009).

Kinberger, G., et al., "Design, synthesis and in vivo results of chemically-modified antisense oligonucleotides targeting microRNA-122," Abstracts of Papers, 234th ACS National Meeting and Exposition, Boston, Massachusetts, United States, Aug. 19-23, 2007, 1 page.

Klein, M., et al., "Homeostatic regulation of MeCP2 expression by a CREB-induced microRNA," *Nat. Neurosci.*10:1513-1514, Nature Publishing Group, United States (2007).

Kocerha, J., et al, "microRNAs in CNS Disorders," *Neuromol. Med.* 11:162-172, Humana Press, United States (2009).

Koch, T. and Ørum, H., "Locked Nucleic Acid," in *Antisense Drug Technology, Principles, Strategies and Applications*, Crooke, S., ed., pp. 519-564, Taylor & Francis Group, United Kingdom (2008).

Koch, T., et al., "Locked Nucleic Acid: Properties and Therapeutic Aspects," in Therapeutic Oligonucleotides, Kurreck, J., ed., pp. 103-141, Royal Society of Chemistry, Cambridge, United Kingdom (2008).

Krützfeldt, J., et al., "Strategies to determine the biological function of microRNAs," *Nature Genetics* 38:S14-S19, Nature Publishing Group, United Kingdom (2006).

Kutay, H., et al., "Downregulation of miR-122 in the Rodent and Human Hepatocellular Carcinomas," *J. Cell. Biol.* 99:671-678, Wiley-Liss, United States (2006).

Lagos-Quintaña, M., et al., "Identification of Novel Genes Coding for Small Expressed RNAs," *Science* 294:853-858, American Association for the Advancement of Science, United States (2001).

Landthaler, M., et al., "Sequence-specific inhibition of microRNA and siRNA-induced RNA silencing" [Poster abstract] siRNAs and miRNAs Keystone Symposium, Keystone Resort, Colorado, United States, Apr. 14-19, 2004, 1 page.

Lanford, R., et al., "Antagonizing MicroRNA-122 and Treatment of Hepatitis C Virus Infection," *Hepatology* 51:1461-1465, Wiley, United States (2010).

Lanford, R., et al., "The Accelerating Pace of HCV Research: A Summary of the 15th International Symposium on Hepatitis C Virus and Related Viruses," *Gastroenterology* 136:9-16, W.B. Saunders, United States (2009).

Leaman, D., et al., "MiRNA function in *Drosophila* development," [Poster abstract] siRNAs and miRNAs Keystone Symposium, Keystone Resort, Colorado, United States, Apr. 14-19, 2004, 1 page.

Lee, Y. and Dutta, A. "The tumor suppressor microRNA let-7 represses the HMGA2 oncogene" *Genes Dev.* 21:1025-1030, Cold Spring Harbor Laboratory Press, United States (2007).

Le Sage, C., et al., "Regulation of the CDKN1B/p27 tumor suppressor by miR-221 and miR-222 promotes cancer cell proliferation," *Cell* 6:3699-3708, Nature Publishing Group, United Kingdom (2007).

Lin, C., et al., "mir-122 targets an anti-apoptotic gene, Bcl-w in human hepatocellular carcinoma cell lines," *Biochem. Biophys. Res. Comm.* 375:315-320, Academic Press, United States (2008).

Lindenbach, B., et al., "Complete Replication of Hepatitis C Virus in Cell Culture," *Science* 309:623-626, American Association for the Advancement of Science, United States (2005).

Love, T., et al., "Not miR-ly small RNAs: Big potential for microRNAs in therapy," *J. Allergy. Clin. Immunol.* 121:309-319, Mosby, United States (2008).

Lupberger, J., et aL, "RNAi—A powerful tool to unravel hepatitis C virus-host interactions within the infectious live cycle," *J. Hepatol.* 48:523-525, Elsevier, United Kingdom (2007).

Machlin, E., et al., "Masking the 5' terminal nucleotides of the hepatitis C virus genome by an unconventional microRNA-target RNA complex," *Proc. Natl. Acad. Sci. USA* 108:3193-3198, National Academy of Sciences, USA (2011).

McLeod, B., et aL, "The 'real world' utility of miRNA patents: lessons learned from expressed sequence tags," *Nat. Biotechnol.* 29:129-133, Nature Publishing Group, United Kingdom (2011).

Mayr, C., et al., "Disrupting the Pairing Between let-7 and Hmga2 Enhances Oncogenic Transformation," *Science* 315:1576-1579, American Association for the Advancement of Science, United States (2007).

Meister, G., "Sequence-specific inhibition of microRNA- and siRNA-induced RNA silencing," *RNA* 10:544-550, Cold Spring Harbor Press, United States (2004).

Metzler, M., et al., "High expression of precursor microRNA-155/BIC RNA in children with Burkitt lymphoma," *Genes Chromosomes Cancer* 39:167-169, Wiley-Liss, United States (2004).

Mirnezami, A., et al., "MicroRNAs: Key players in carcinogenesis and novel therapeutic targets," *Eur. J. Surg. Oncol.* 35:339-347, Elsevier, Netherlands (2009).

Miska, E., et al., "Most *Caenorhabditis elegans* microRNAs are individually not essential for development or viability," *PLoS Genet.* 3:e215, Public Library of Science, United States (2007).

Moore, S., "'Antisense' touted as medical hope, but critics ask if promise is reasonable," Wall Street Journal (Eastern edition), New York, NY, United States, May 10, 1996, pp. A5A, 6 pages (1996).

Naguibneva, I., et al., "MicroRNAs in terminal muscle differentiation," [Poster abstract] siRNAs and miRNAs Keystone Symposium, Keystone Resort, Colorado United States, Apr. 14-19, 2004, 1 page.

Naguibneva, I., et al., "An LNA-based loss-of-function assay for micro-RNAs," *Biomed. Pharmacother.* 60:633-638, Elsevier Ltd., United Kingdom (2006).

Nielsen, S., et al., "Association between Hepatitis C Virus and Very-Low-Density Lipoprotein (VLDL)/LDL Analyzed in Iodixanol Density Gradients," *J. Virol.* 80:2418-2428, American Society for Microbiology, United States (2006).

Niepmann, M. "Activation of hepatitis C virus translation by a liver-specific microRNA," *Cell Cycle* 8:1473-1477, Landes Bioscience, United States (2009).

Norman, K. and Sarnow, P., "Modulation of Hepatitis C Virus RNA Abundance and the Isoprenoid Biosynthesis Pathway by MicroRNA miR-122 Involves Distinct Mechanisms," *J. Virol.* 84:666-670, American Society for Microbiology, United States (2010).

Pan, Q., et al., "New therapeutic opportunities for Hepatitis C based on small RNA," *World J. Gastroenterol.* 13:4431-4436, Baishideng Pub., China (2007).

Pan, Q., et al., "Prospects of RNAi and microRNA-based therapies for hepatitis C," *Expert Opin. Biol. Ther.*9:713-724, Informa Healthcare, United Kingdom (2009).

Park, J., et al., "Antisense Inhibition of microRNA-21 or -221 Arrests Cell Cycle, Induces Apoptosis, and Sensitizes the Effects of Gemcitabine in Pancreatic Adenocarcinoma," *Pancreas* 38:e190-e199, Lippincott Williams & Wilkins, United States (2009).

Pasquinelli, A., et aL, "Conservation of the sequence and temporal expression of *let-7* heterochronic regulatory RNA," *Nature* 408:86-89, Nature Publishing Group, United Kingdom (2000).

Pavio, N. and Lai, M., "The hepatitis C virus persistence: how to evade the immune system?," *J. Biosci.* 28:287-304, Springer, India (2003).

Pietschmann, T., et al., "Construction and characterization of infectious intragenotypic and intergenotypic hepatitis C virus chimeras," *Proc. Natl. Acad. Sci. USA* 103:7408-7413, National Academy of Sciences, United States (2006).

Pietschmann, T., et al., "Production of Infectious Genotype 1b Virus Particles in Cell Culture and Impairment by Replication Enhancing Mutations," *PLoS Pathogens* 5:1-14, Public Library of Science, United States (2009).

Regulus Therapeutic, Press release, "Regulus Therapeutics and GlaxoSmithKline Establish New Collaboration to Develop and Commercialize microRNA Therapeutics Targeting miR-122," Feb. 25, 2010, 2 pages.

Robertson, B., et al., "Specificity and functionality of microRNA inhibitors," *Silence* 1:10, BioMed Central, United Kingdom (2010).

Roberts, A. and Jopling, C., "Targeting viral infection by microRNA inhibition," *Genome Biology* 1:201, Biomed Central Ltd., United Kingdom (2010).

Santaris Pharma, In House Memo to Attorney at Horton, dated Jan. 27, 2009, Santaris Memo 2009 (Confidential), 4 pages.

Sarasin-Filipowicz, M., et al., "Decreased levels of microRNA miR-122 in individuals with hepatitis C responding poorly to interferon therapy," *Nature Med.* 15:31-33, Nature Publishing Company, United States (2009).

Sarnow, P., et al., "MicroRNAs: expression, avoidance and subversion by vertebrate viruses," *Nat. Rev. Microbiol.* 4:651-659, Nature Publishing Group, United Kingdom (2006).

Shan, Y., et al., "Reciprocal Effects of Micro-RNA-122 on Expression of Heme Oxygenase-1 and Hepatitis C Virus Genes in Human Hepatocytes," Hepatology 80A, AASLD Abstract #181, Wiley, United States (2006).

Shan, Y., et al., "An Antagomir of Mir-122 Down-Regulates Hepatitis C Virus Infection and Up-Regulates Heme Oxygenase-1 Expression in Human Hepatocytes," *Gastroenterology* 132:A824, W.B. Saunders, United States (2007).

Song, J., et al., "Crystal Structure of Argonaute and Its Implications for RISC Slicer Activity," *Science* 305:1434-1437, American Association for the Advancement of Science, United States (2004).

Stein, C., "How to Design an Antisense Oligodeoxynucleotide Experiment: A Consensus Approach," *Antisense Nucleic Acid Drug Dev.* 8:129-132, Mary Ann Liebert, Inc., United States (1998).

Stenvang, J. and Kauppinen, S., "MicroRNAs as targets for antisense-based therapeutics," *Expert. Opin. Biol. Ther.* 8:59-81, Informa Healthcare, United Kingdom (2008).

Stenvang, J., et al., "Targeting of microRNAs for therapeutics," *Biochem. Soc. Trans.* 36:1197-1200, Portland Press on the behalf of The Biochemical Society, United Kingdom (2008).

Swayze, E., et aL, "Antisense oligonucleotides containing locked nucleic acid improve potency but cause significant hepatotoxicity in animals," *Nucleic Acids Res.* 35:687-700, Oxford University Press, United Kingdom (2007).

Timmerman, L., "Regulus, the microRNA child of Isis and Alnylam, strikes potential $150M deal with Glaxo," Xconomy.com, accessed at: http://www.xconomy.com/san-diego/2010/02/25/regulus-the-microrna-child-of-isis-and-alnylam-strikes-potential-150m-deal-with-glaxo/, accessed on Feb. 25, 2010, 2 pages.

Tsai, W., et al., "MicroRNA-122, a Tumor Suppressor MicroRNA that Regulates Intrahepatic Metastasis of Hepatocellular Carcinoma," *Hepatology* 49:1571-1582, Wiley, United States (2009).

Uhlmann, E. and Peyman, A., "Antisense Oligonucleotides: A New Therapeutic Principle," *Chem. Rev.* 90:543-584, American Chemical Society, United States (1990).

van Rooij, E. and Olson, E., "MicroRNAs: powerful new regulators of heart disease and provocative therapeutic targets," *J. Clinic. Invest.* 117:2369-2376, American Society for Clinical Investigation, United States (2007).

Wakita, T., et al., "Production of infectious hepatitis C virus in tissue culture from a cloned viral genome," *Nat. Med.* 11:791-796, Nature Publishing Company, United States (2005).

Wakita, T., et al., and Pietschmann, T., et al., Abstracts Nos. O-33 and O-34, 11th International Symposium on HCV & Related Viruses, Heidelberg, Germany, Oct. 3-7, 2004, 1 page.

Wang, X., et al., "MicroRNA-122a functions as a novel tumor suppressor downstream of adenomatous polyposis coli in gastrointestinal cancers," *Biochem. Biophys. Res. Comm.* 387:376-380, Academic Press, United States (2009).

Wang, Z., et al., "miRNAs at the heart of the matter," *J. Mol. Med.* 86:771-783, Springer International, Germany (2008).

Watanabe, T., et al., "Plasma Protein Binding of an Antisense Oligonucleotide Targeting Human ICAM-1 (ISIS 2302)," *Oligonucleotides* 16:169-180, Mary Ann Liebert, Inc., United States (2006).

Wehner, K. and Sarnow, P., "Regulation of mRNA molecules by microRNAs," Translational Control in Biology & Medicine, Cold Spring Harbor Monograph Series, vol. 48, pp. 297-318, Cold Spring Harbor Laboratory Press, NY, United States (2007).

Wengel, J., "LNA (Locked Nucleic Acid)," in *Antisense Drug Technology, Principles, Strategies and Applications*, Crooke, S., ed. pp. 339-357, Marcel Dekker, Inc., New York (2001).

Wengel, J., et al., "Chemistry of locked nucleic acids (LNA): Design, synthesis, and bio-physical properties," *Lett. Pept. Sci.* 10:237-253, Kluwer Academic Publishers, Germany (2004).

Wu, X., et al., "miR-122 affects the viability of apoptosis of hepatocellular carcinoma cells," *Scand. J. Gastroenter.* 44:1332-1339, Informa Healthcare, United Kingdom (2009).

Xiao, J., et al., "Novel Approaches for Gene-Specific Interference via Manipulating Actions of MicroRNAs: Examination on the Pacemaker Channel Genes HCN2 and HCN4," *J. Cell. Physiol.* 212:285-292, Wiley-Liss, New York, United States (2007).

Xie, Z., et al., "Transmission of Hepatitis C Virus Infection to Tree Shrews," *Virology* 244:513-520, Academic Press, New York, United States (1998).

Yi, M. and Lemon, S., "Adaptive Mutations Producing Efficient Replication of Genotype 1a Hepatitis C Virus RNA in Normal Huh7 Cells," *J. Virol.* 78:7904-7915, American Society for Microbiology, United States (2004).

Yi-Ping, L., et al., "-MicroRNA-122 antagonism against hepatitis C virus genotypes 1-6 and reduced efficacy by host RNA insertion or mutations in the HCV 5' UTR," *Proc. Natl. Acad Sci. USA* 108:4991-4996, National Academy of Sciences, United States (2011).

Zamecnik, P. and Stephenson, M., "Inhibition of Rous sarcoma virus replication and cell transformation by a specific oligodeoxynucleotide," *Proc. Natl. Acad. Sci. USA* 75:280-284, National Academy of Sciences, United States (1978).

Zhong, J. et al., "Robust hepatitis C virus infection in vitro," *Proc. Natl. Acad. Sci. USA* 102: 9294-9299, National Academy of Sciences, United States (2005).

Baofeng Y., et al, P.R.C patent application No. 200710072002, Extract from SIPO database, accessed on Jun. 6, 2007, 1 page.

Response and Amended Claims dated Sep. 17, 2007 in Office Action mailed on Mar. 16, 2007, U.S. Appl. No. 10/909,125, Esau et al., filed Jul. 30, 2004, 14 pages.

Response from Applicant dated May 13, 2008, in Office Action mailed Nov. 13, 2007 on U.S. Appl. No. 10/909,125, Esau et al., filed Jul. 30, 2004, 10 pages.

Response and Amended Claims dated Aug. 4, 2009 in reply to Office Action mailed on Mar. 16, 2007 in U.S. Appl. No. 10/909,125, 12 pages.

Response to Office Action mailed Sep. 13, 2006 in U.S. Appl. No. 11/122,328, Sarnow et al., filed May 3, 2005, 11 pages.

International Search Report and Written Opinion for International Appl. No. PCT/DK2007/000169, European Patent Office, Netherlands, mailed on Mar. 7, 2008, 12 pages.

International Search Report for International Appl. No. PCT/EP2007/060703, European Patent Office, Netherlands, mailed on Aug. 13, 2008, 7 pages.

International Search Report for International Appl. No. PCT/EP2008/053309, European Patent Office, Netherlands, mailed on Jul. 18, 2008, 3 pages.

International Search Report for International Appl. No. PCT/EP2008/066920, European Patent Office, Netherlands, mailed on Jun. 17, 2009, 9 pages.

Office Action mailed on Nov. 5, 2010 in U.S. Appl. No. 12/400,625, inventor s Kauppinen, et al., filed Mar. 9, 2009, 11 pages.

Bartenschlager, R. and Lohmann, V., "Replication of hepatitis C virus," *J. Gen. Virol.* 81:1631-1648, Great Britain (2000).

Janssen, H., et al., "A Randomized, Double-blind, Placebo (PLB) Controlled Safety and Anti-viral Proof of Concept Study of Miravirsen (MIR), an Oligonucleotide Targeting miR-122, In Treatment Naive Patients with Genotype 1 (GT1) Chronic HCV Infection," (Abstract) American Association for the Study of Liver Diseases (AASLD) 2011 Annual Meeting Abstract, Nov. 7, 2011, San Francisco, California, 1 page.

"Declaration of Dr. Susanna Obad," from File History of European Patent No. 1747023, dated Sep. 27, 2011, 4 pages.

"Declaration under 37 CFR 1.132 of Dr. Christine Esau," dated Apr. 15, 2011, from the File History of U.S. Appl. No. 11/513,102, filed Aug. 29, 2006, 5 pages.

"Exclusive License and Nonexclusive Option Agreement Between Glaxo Group Limited and Regulus Therapeutics Inc.," Isis Pharmaceutics (Confidential), Exhibit 10.2, License Agreement, 56 pages.

McNair, MD, Trisha, "Cholesterol," BBC Health, accessed at: http://www.bbc.co.uk/health/physical_health/conditions/cholesterol1.shtml, accessed on Nov. 7, 2011, 3 pages.

"Opposition against European Patent No. 1 931 782 B1 granted to Isis Pharmaceuticals Inc.," Document No. G0119EP, Santaris Pharma A/S, Oct. 4, 2011, 46 pages.

Opposition Statement by Santaris Pharma A/S to EP-B-1747023, in the name of the Board of Trustees of the Leland Stanford Junior University, 94 pages.

Santaris Pharma A/S report new clinical data from miravirsen Phase 2a study to treat Hepatitis C in late-breaking oral presentation at the AASLD annual meeting, (Press Release) American Association for the Study of Liver Diseases (AASLD) 2011 Annual Meeting Abstract, Nov. 7, 2011, San Francisco, California, 2 pages.

Bereguer, M., et al., "Delayed Onset of Severe Hepatitis C-Related Liver Damage Following Liver Transplantation: A Matter of Concern?," *Liver Transpl.* 9:1152-1158, W.B. Saunders Co., United States (2003).

Rotondi, M., et al., "Serum CXCL10 levels and occurrence of thyroid dysfunction in patients treated with interferon-α therapy for hepatitis C virus-related hepatitis," *Eur. J. Endocrinol.* 156:409-414, Society of the European Journal of Endocrinology, United Kingdom (2007).

Office Action mailed on Aug. 3, 2011 in U.S. Appl. No. 12/295,960, inventors Elmén, et al., filed Mar. 30, 2009, 43 pages.

Office Action mailed on Oct. 25, 2011 in U.S. Appl. No. 12/767,631, inventors Hildebrant-Eriksen, et al., filed Apr. 26, 2010, 118 pages.

Office Action mailed on Nov. 22, 2011 in U.S. Appl. No. 12/400,625, inventors Kauppinen, et al., filed Mar. 9, 2009, 42 pages.

Co-pending U.S. Appl. No. 13/006,099, inventors Elmén, et al., filed Jan. 13, 2011 (Not Published).

Co-pending U.S. Appl. No. 13/415,685, field March 8, 2012, United States Patent Office, Alexandria, VA, Untied States (Not Published).

Office Action mailed on Dec. 30, 2011 in U.S. Appl. No. 12/921,339, inventor Kauppinen, filed Nov. 29, 2010, 25 pages.

Office Action mailed on May 10, 2012 in U.S. Appl. No. 13/006,099, inventors Elmen et al., filed Jan. 13, 2011, 12 pages.

Office Action mailed on May 2, 2012 in U.S. Appl. No. 12/400,625, inventors inventors Kauppinen, et al., filed Mar. 9, 2009, 35 pages.

Office Action mailed on May 25, 2012 in U.S. Appl. No. 12/767,631, inventors Hildebrant-Eriksen, et al., filed Apr. 26, 2010, 29 pages.

* cited by examiner

COMPOUND 3205  5'- GATAAGCT - 3'
COMPOUND 3219  5'- CGTAATGA - 3'
COMPOUND 3218  5'- GGTAAACT - 3'

| Name | Mature miRNA sequence | S (2-8) | ES (2-9) | NE (9-16) | Total (2-16) |
|---|---|---|---|---|---|
| let-7a | UGAGGUAGUAGGUUGUAUAGUU | N/A | N/A | N/A | N/A |
| let-7b | UGAGGUAGUAGGUUGUGUGUU | 0 | 0 | 0 | 0 |
| let-7c | UGAGGUAGUAGGUUGUAUGGUU | 0 | 0 | 0 | 0 |
| let-7d | AGAGGUAGUAGGUUGCAUAGUU | 0 | 0 | 1 | 1 |
| let-7e | UGAGGUAGGAGGUUGUAUAGUU | 0 | 1 | 0 | 1 |
| let-7f | UGAGGUAGUAGAUUGUAUAGUU | 0 | 0 | 1 | 1 |
| let-7g | UGAGGUAGUAGUUUGUACAGUU | 0 | 0 | 1 | 1 |
| let-7i | UGAGGUAGUAGUUUGUGCUGUU | 0 | 0 | 1 | 1 |
| miR-98 | UGAGGUAGUAAGUUGUAUUGUU | 0 | 0 | 1 | 1 |

| Number | Compound | Sequence (5' to 3')[a] | Length (nt) | Complementary target(s) |
|---|---|---|---|---|
| 1. | COMPOUND 3226 | A-C-a-A-c-C-T-a-c-T-a-C-c-T-C | 15 | let-7a/b/c |
| 2. | COMPOUND 3236 | G-C-a-A-c-C-T-a-c-T-a-C-c-T-C | 15 | let-7d |
| 3. | COMPOUND 3237 | A-C-a-A-c-C-T-c-c-T-a-C-c-T-C | 15 | let-7e |
| 4. | COMPOUND 3238 | A-C-a-A-a-C-T-a-c-T-a-C-c-T-C | 15 | let-7g/i |
| 5. | COMPOUND 3239 | C-T-A-C-C-T-C | 7 | all members |
| 6. | COMPOUND 3240 | C-T-A-A-C-T-C | 7 | none |
| 7. | COMPOUND 3227 | A-C-T-A-C-C-T-C | 8 | all except let-7e |
| 8. | COMPOUND 3232 | T-A-C-C-T-C | 6 | all members |
| 9. | COMPOUND 3234 | T-$N_1$-C-T-A-C-C-T-C | 9 | all members[b] |
| 10. | COMPOUND 3235 | T-$N_2$-C-T-A-C-C-T-C | 9 | all members[b] |

[a]Capital and lower case letters denote LNA and DNA, respectively.
[a]Both 9-mers theoretically target all members since they contain 2 different universally hybridizing chemistries at their 2$^{nd}$ position.

FIG. 27

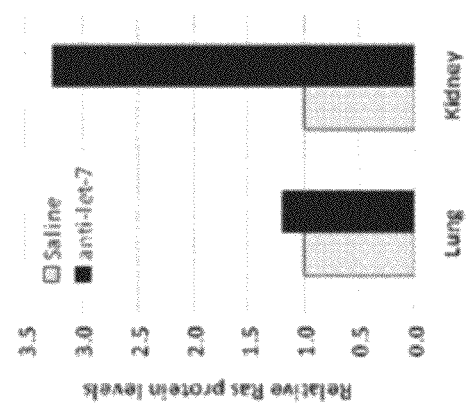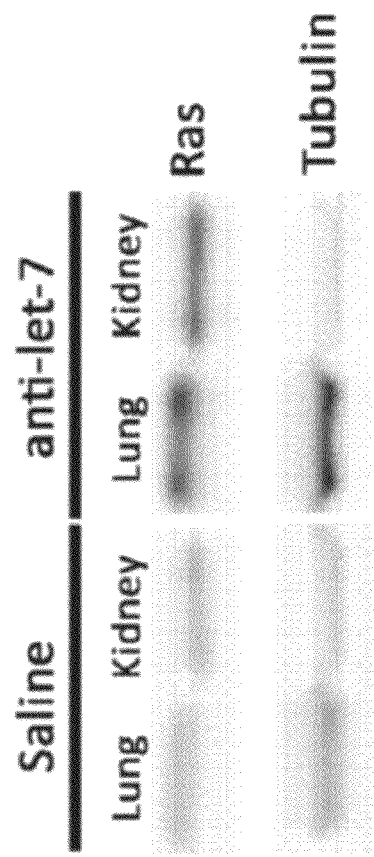
FIG. 37

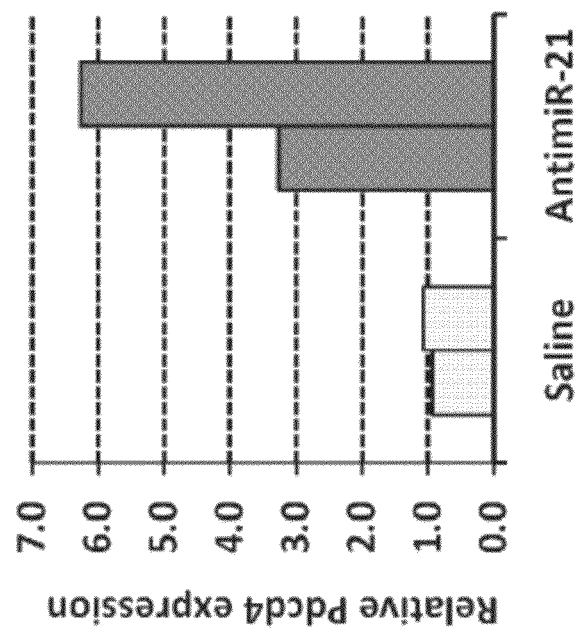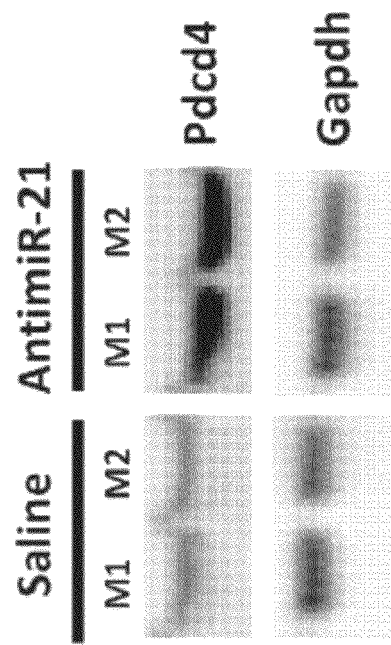
FIG. 38

MICRORNAS

RELATED APPLICATIONS

This application claims priority from four applications: U.S. 60/977,497 filed 4 Oct. 2007, U.S. 60/979,217 filed 11 Oct. 2007, U.S. 61/028,062, filed 12 Feb. 2008, and EP08104780, filed 17 Jul. 2008, all of which are hereby incorporated by reference. Furthermore we reference and incorporate by reference WO2007/112754 and WO2007/112753 which are earlier applications from the same applicants.

REFERENCE TO SEQUENCE LISTING SUBMITTED ELECTRONICALLY VIA EFS-WEB

The content of the electronically submitted sequence listing (Name: 2763_0130004_sequence_listing_ascii.txt; Size: 567,833 bytes; and Date of Creation: Jun. 4, 2012) filed with the application is incorporated herein by reference in its entirety.

FIELD OF THE INVENTION

The present invention relates to very short oligonucleotides which target and inhibit microRNAs in vivo, and their use in medicaments and pharmaceutical compositions.

BACKGROUND OF THE INVENTION

MicroRNAs (miRNAs) are an abundant class of short endogenous RNAs that act as post-transcriptional regulators of gene expression by base-pairing with their target mRNAs. They are processed from longer (ca 70-80 nt) hairpin-like precursors termed pre-miRNAs by the RNAse III enzyme Dicer. MicroRNAs assemble in ribonucleoprotein complexes termed miRNPs and recognize their target sites by antisense complementarity thereby mediating down-regulation of their target genes. Near-perfect or perfect complementarity between the miRNA and its target site results in target mRNA cleavage, whereas limited complementarity between the microRNA and the target site results in translational inhibition of the target gene.

A summary of the role of microRNAs in human diseases, and the inhibition of microRNAs using single stranded oligonucleotides is provided by WO2007/112754 and WO2007/112753, which are both hereby incorporated by reference in its entirety. WO2008046911, hereby incorporated by reference, provides microRNA sequences which are associated with cancer. Numerous microRNAs have been associated with disease phenotypes and it is therefore desirable to provide substances capable of modulating the availability of microRNAs in vivo. WO2007/112754 and WO2007/112753 disclose short single stranded oligonucleotides which are considered to form a strong duplex with their target miRNA. SEQ ID NOs 1-45 are examples of anti microRNA oligonucleotides as disclosed in WO2007/112754 and WO2007/112753.

SUMMARY OF THE INVENTION

The present invention is based upon the discovery that the use of very short oligonucleotides which target microRNAs and which have a high proportion of nucleotide analogue nucleotides, such as LNA nucleotides, are highly effective in alleviating the repression of RNAs, such as an mRNA, by the targeted microRNAs in vivo.

The present invention provides an oligomer a contiguous sequence of 7, 8, 9 or 10 nucleotide units in length, for use in reducing the effective amount of a microRNA target in a cell or an organism, wherein at least 70%, such as at least 80% of the nucleotide units of the oligomer are selected from the group consisting of LNA units and 2' substituted nucleotide analogues.

The present invention provides an oligomer a contiguous sequence of 7, 8, 9 or 10 nucleotide units in length, for use in reducing the effective amount of a microRNA target in a cell or an organism, wherein at least 70% of the nucleotide units of the oligomer are selected from the group consisting of LNA units and 2' substituted nucleotide analogues, and wherein at least 50%, such as at least 60%, such as at least 70% of the nucleotide units of the oligomer are LNA units.

The invention provides oligomers of between 7-10 nucleotides in length which comprises a contiguous nucleotide sequence of a total of between 7-10 nucleotides, such as 7, 8, 9, nucleotide units, wherein at least 50% of the nucleotide units of the oligomer are nucleotide analogues.

The invention further provides for an oligomer of between 7-10 nucleotides in length which comprises a contiguous nucleotide sequence of a total of between 7-10 nucleotides, such as 7, 8, 9, or 10, nucleotide units, wherein the nucleotide sequence is complementary to a corresponding nucleotide sequence found in mammalian or viral microRNA, and wherein at least 50% of the nucleotide units of the oligomer are nucleotide analogues.

The present invention provides olgiomers according to the invention as a medicament.

The present invention provides pharmaceutical compositions comprising the oligomer of the invention and a pharmaceutically acceptable diluent, carrier, salt or adjuvant.

The invention provides for a conjugate comprising an oligomer according to the invention, conjugated to at least one non-nucleotide or polynucleotide entity, such as a sterol, such as cholesterol.

The invention provides for the use of an oligomer or a conjugate according to the invention, for the manufacture of a medicament for the treatment of a disease or medical disorder associated with the presence or over-expression of a microRNA, such as one or more of the microRNAs referred to herein.

The invention provides for the treatment of a disease or medical disorder associated with the presence or overexpression of the microRNA, comprising the step of administering a composition (such as the pharmaceutical composition) comprising an oligomer or conjugate according to the invention to a patient suffering from or likely to suffer from said disease or medical disorder.

The invention provides for a method for reducing the effective amount of a microRNA target in a cell or an organism, comprising administering the oligomer of the invention, or a composition (such as a pharmaceutical composition) comprising the oligomer or conjugate according to the invention to the cell or organism.

The invention provides for a method for reducing the effective amount of a microRNA target in a cell or an organism, comprising administering the oligomer or conjugate or pharmaceutical composition according to the invention to the cell or organism.

The invention provides for a method for de-repression of a target mRNA (or one or more RNAs) in a cell or an organism, comprising administering an oligomer or conjugate according to the invention, or a composition comprising said oligomer or conjugate, to said cell or organism.

The invention provides for the use of an oligomer or a conjugate according to the invention, for inhibiting the mircoRNA in a cell which comprises said microRNA, such as a human cell. The use may be in vivo or in vitro.

HepG2 cells were co-transfected with luciferase reporter plasmid containing a perfect match target site for miR-21 and LNA-antimiRs at different concentrations. After 24 hours, cells were harvested and luciferase activity measured. Shown are the mean values (bars=s.e.m) of three independent experiments where the *renilla*/firefly ratios have been normalized against 0 nM empty vector without target site (=control). Shown is also a schematic presentation of the miR-21 sequence and the design and position of the LNA-antimiRs.

Figure 21:
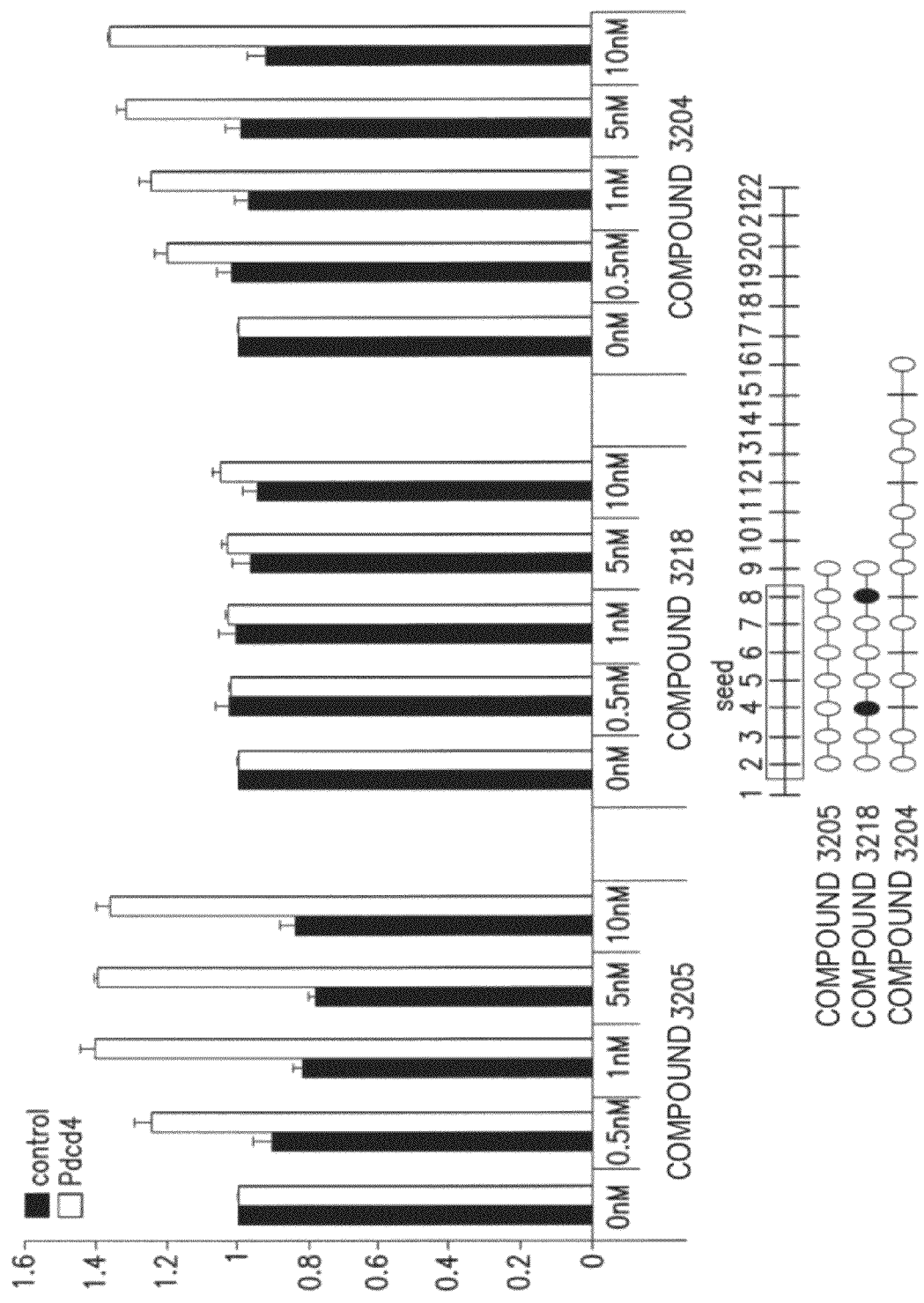

FIG. 21. Validation of interaction of the Pdcd4 3'UTR and miR-21 by the 8-mer Compound 3205 (SEQ ID NO: 2) LNA-antimiR versus the 15-mer Compound 3204 (SEQ ID NO: 1) and an 8-mer with two mismatches Compound 3218 (SEQ ID NO: 16).

Huh-7 cells were co-transfected with a luciferase reporter plasmid containing part of the 3'UTR of Pdcd4 gene, pre-miR-21 (10 nM) and LNA-antimiRs at different concentrations. After 24 hours, cells were harvested and luciferase activity measured. Shown are the mean values (bars=s.e.m) of three independent experiments where the *renilla*/firefly ratios have been normalized against 0 nM empty vector without target site (=control). Shown is also a schematic presentation of the miR-21 sequence and the design and position of the LNA-antimiRs.

Figure 22:
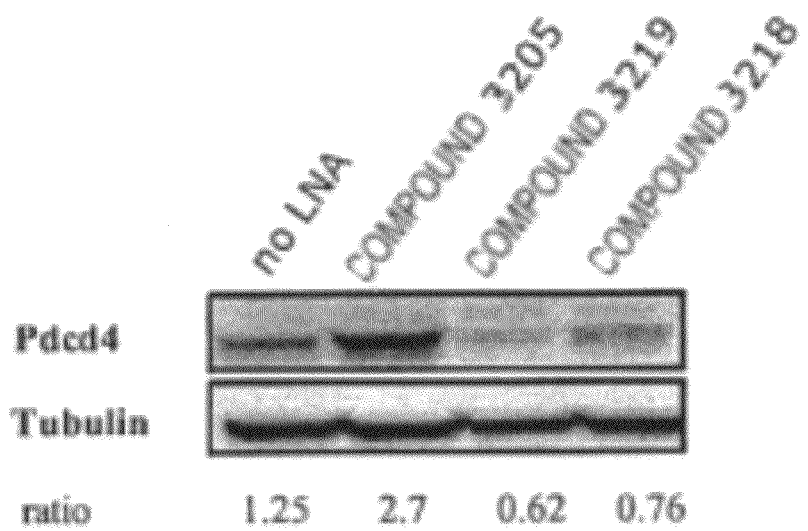

FIG. 22. Antagonism of miR-21 by Compound 3205 (SEQ ID NO: 2) leads to increased levels of Pdcd4 protein levels.

HeLa cells were transfected with 5 nM LNA-antimiR Compound 3205 (SEQ ID NO: 2) (perfect match), or Compound 3219 (SEQ ID NO: 17) LNA scrambled (8 mer) or Compound 3218 (SEQ ID NO: 16) (8-mer mismatch). Cells were harvested after 24 hours and subjected to Western blot with Pdcd4 antibody.

Figure 23:
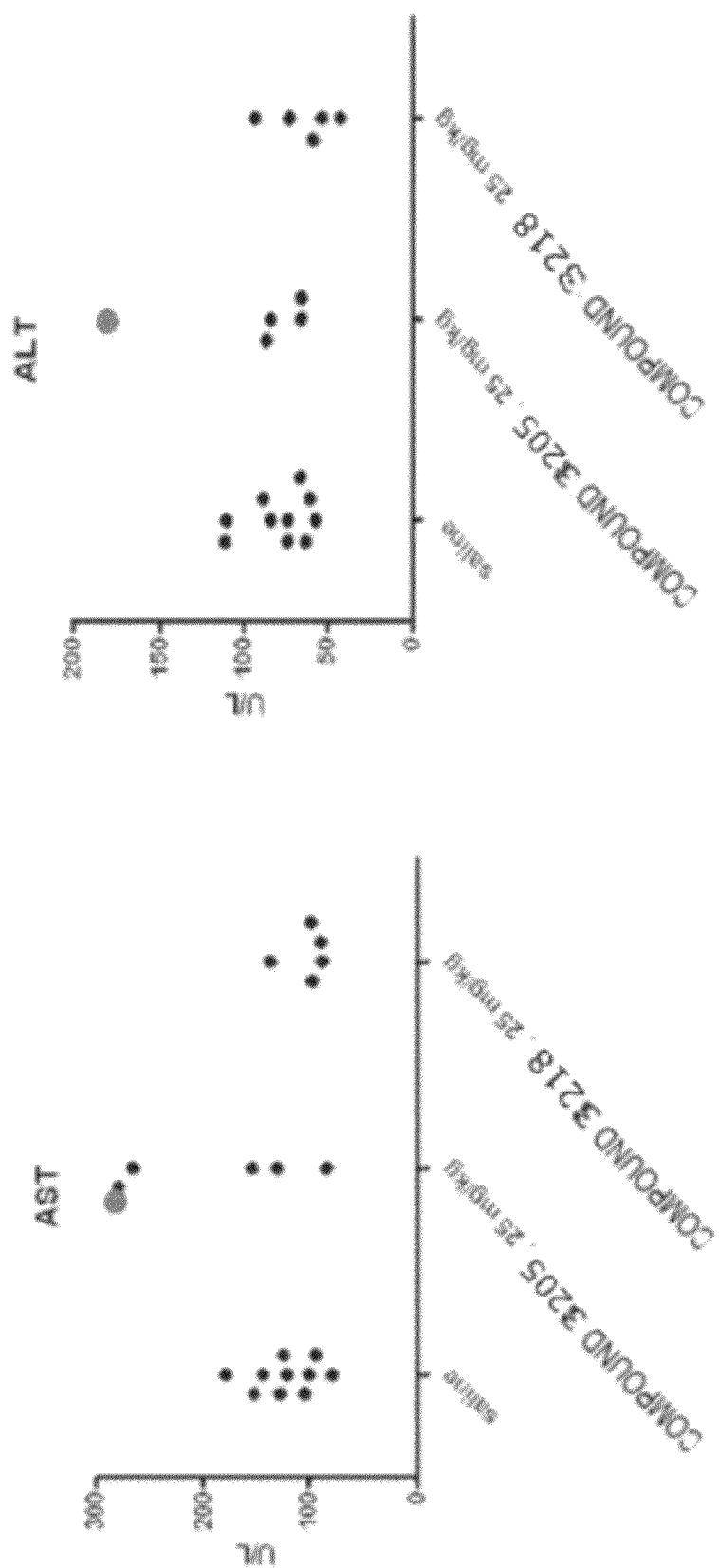

FIG. 23. ALT and AST levels in mice treated with Compound 3205 (SEQ ID NO: 2) (perfect match) or Compound 3218 (SEQ ID NO: 16) (mismatch control). Mice were sacrificed after 14 days and after receiving 25 mg/kg every other day.

Figure 24:
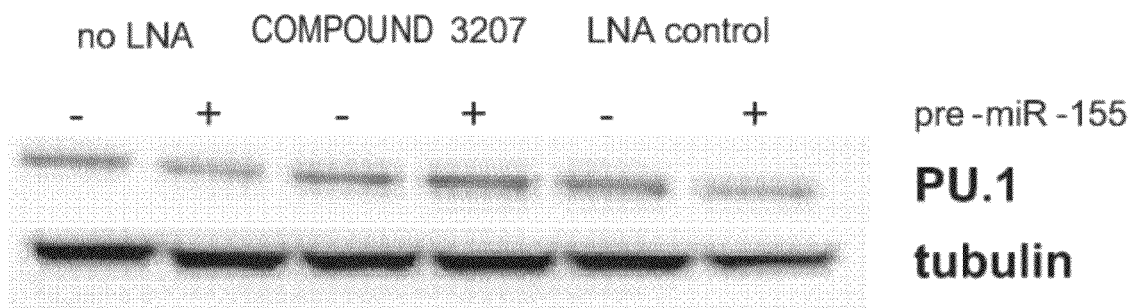

FIG. 24. Assessment of PU.1 protein levels as a functional readout for miR-155 antagonism by short LNA-antimiR Compound 3207 (SEQ ID NO: 4).

THP-1 cells were co-transfected with pre-miR-155 (5 nmol) and different LNA oligonucleotides (5 nM) and 100 ng/ml LPS was added. After 24 hours, cells were harvested and western blot analysis of protein extracts from the THP-1 cells was performed. PU.1 and tubulin are indicated.

Figure 25:
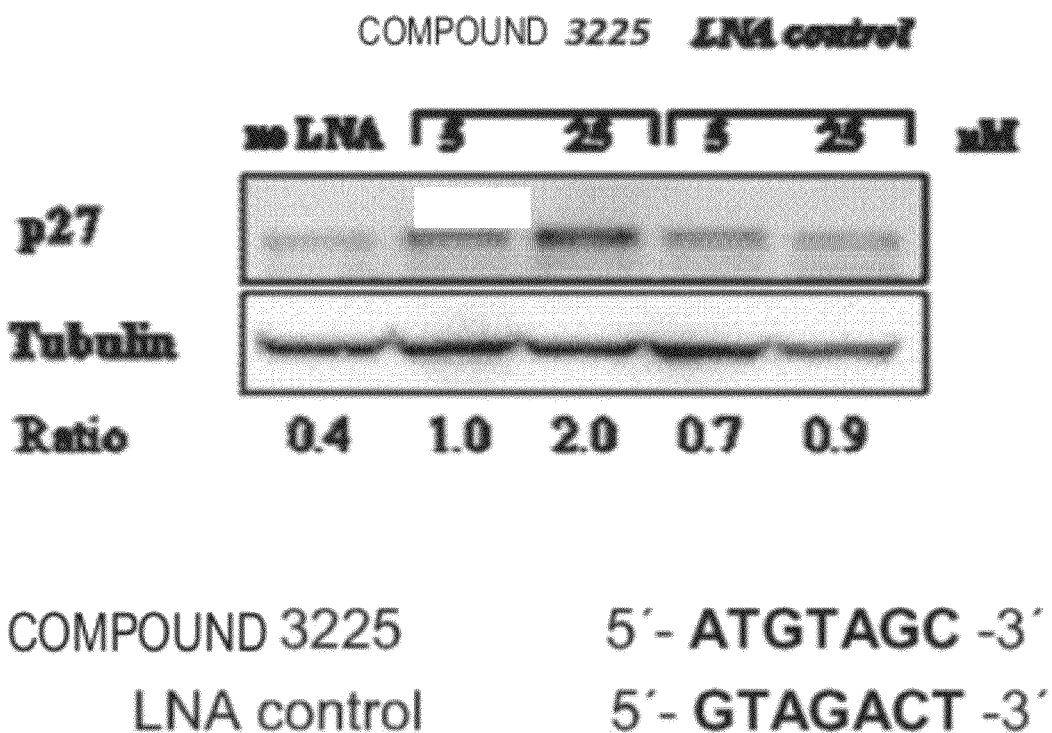

FIG. 25. Assessment of p27 protein levels as a functional readout for antagonism of the miR-221/222 family by the 7-mer Compound 3225 (SEQ ID NO: 23) LNA-antimiR.

PC3 cells were transfected with the 7-mer LNA-antimiR Compound 3225 (SEQ ID NO: 23) targeting both miR-221 and miR-222 and a LNA scrambled control at 5 and 25 nM. After 24 hours, cells were harvested and protein levels were measured on a western blot. Shown are the ratios of p27/tubulin.

Figure 26:
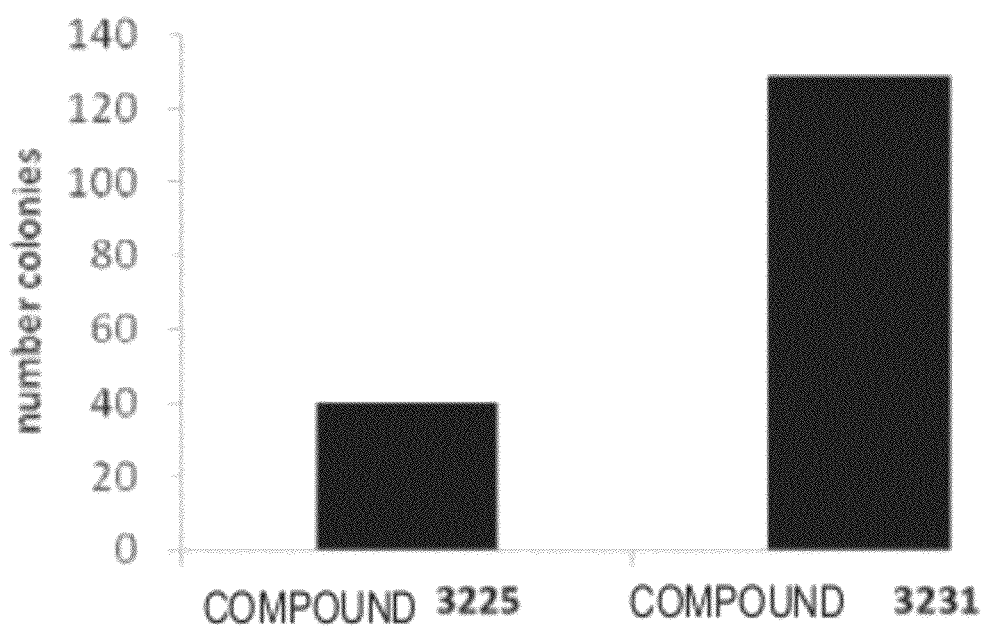

FIG. 26. Knock-down of miR-221/222 by the 7-mer Compound 3225 (SEQ ID NO: 23) (perfect match) LNA-antimiR reduces colony formation in soft agar in PC3 cells.

PC3 cells were transfected with 25 nM of the 7-mer LNA-antimiR Compound 3225 (SEQ ID NO: 23) targeting both miR-221 and miR-222 or a 7-mer scrambled control Compound 3231 (SEQ ID NO: 28). After 24 hours, cells were harvested and seeded on soft agar. After 12 days, colonies were counted. One experiment has been done in triplicate.

FIG. 27. Overview of the human let-7 family, and of tested antagonists.

(upper) The sequences represent the mature miRNA for each member and the box depicts nucleotides 2-16, the positions typically antagonized by LNA-antimiRs (let-7a, SEQ ID NO: 96; let-7b, SEQ ID NO: 98; let-7c, SEQ ID NO: 100; let-7d, SEQ ID NO: 102; let-7e, SEQ ID NO: 104; let-7f, SEQ ID NO: 106; let-7I, SEQ ID NO: 111; miR-98, SEQ ID NO: 947). Columns to the right show the number of nucleotide differences compared to let-7a, within the seed (S: position 2-8), extended seed (ES; position 2-9), and the remaining sequence typically targeted by LNA-antimiRs (NE; position 9-16), respectively. Nucleotides with inverted colors are altered compared to let-7a. (lower) Summary of tested antagonists against the let-7 family, including information on design, length and perfectly complementary targets. All compounds are fully phoshorothiolated.

Figure 28:
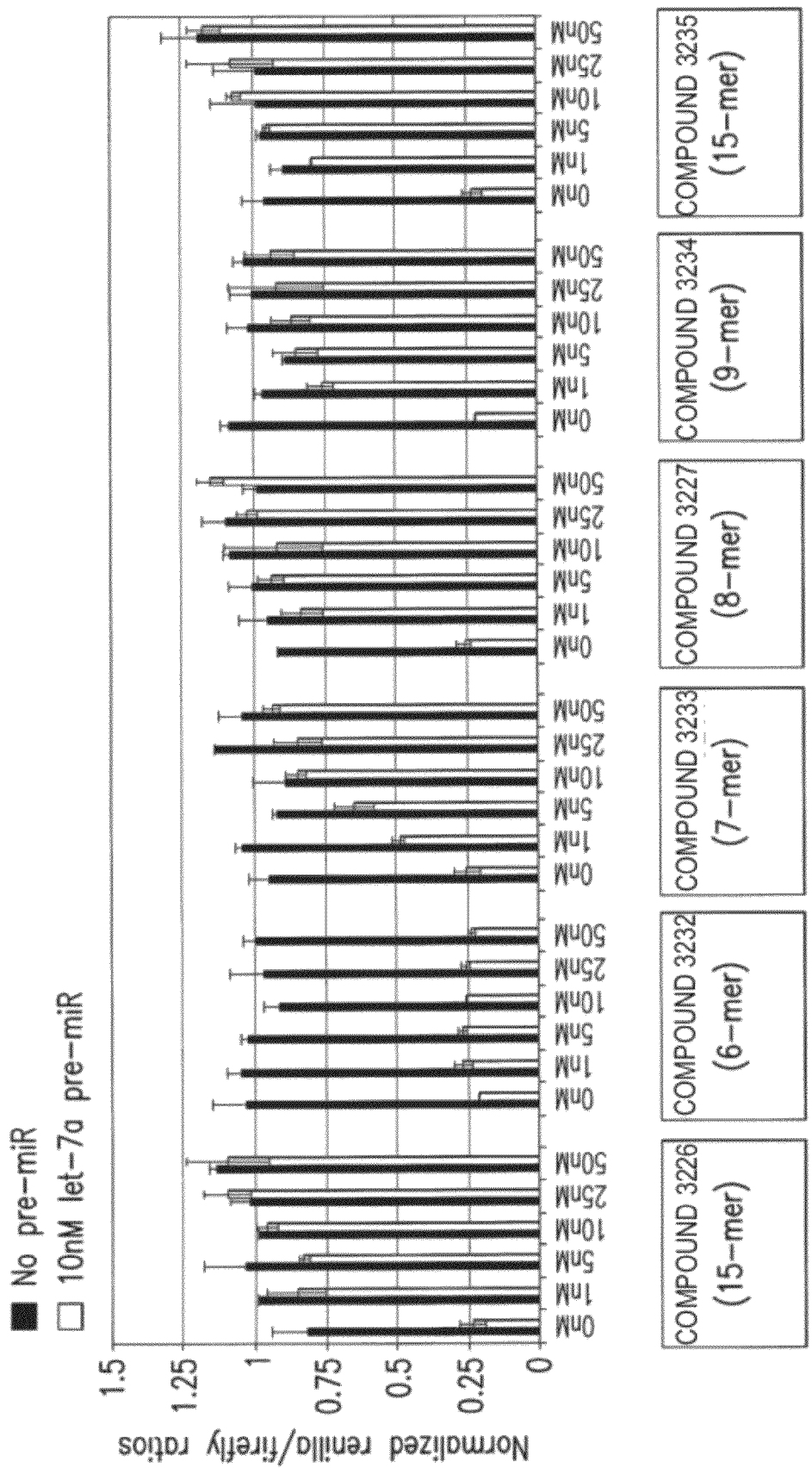

FIG. 28. Assessment of let-7 antagonism by six different LNA-antimiRs in Huh-7 cells using a luciferase sensor assay.

Huh-7 cells were co-transfected with luciferase sensor plasmids containing a partial HMGA2 3'UTR (with four let-7 binding sites), with or without let-7a precursor (grey and black bars, respectively), and with 6 different LNA-antimiRs at increasing concentrations. After 24 hours, cells were harvested and luciferase activity measured. Shown are the mean of *renilla*/firefly ratios for duplicate measurements and standard deviations for each assay. Within each LNA-antimiR group all ratios have been normalized to the average of wells containing no let-7a precursor (black bars).

Figure 29:
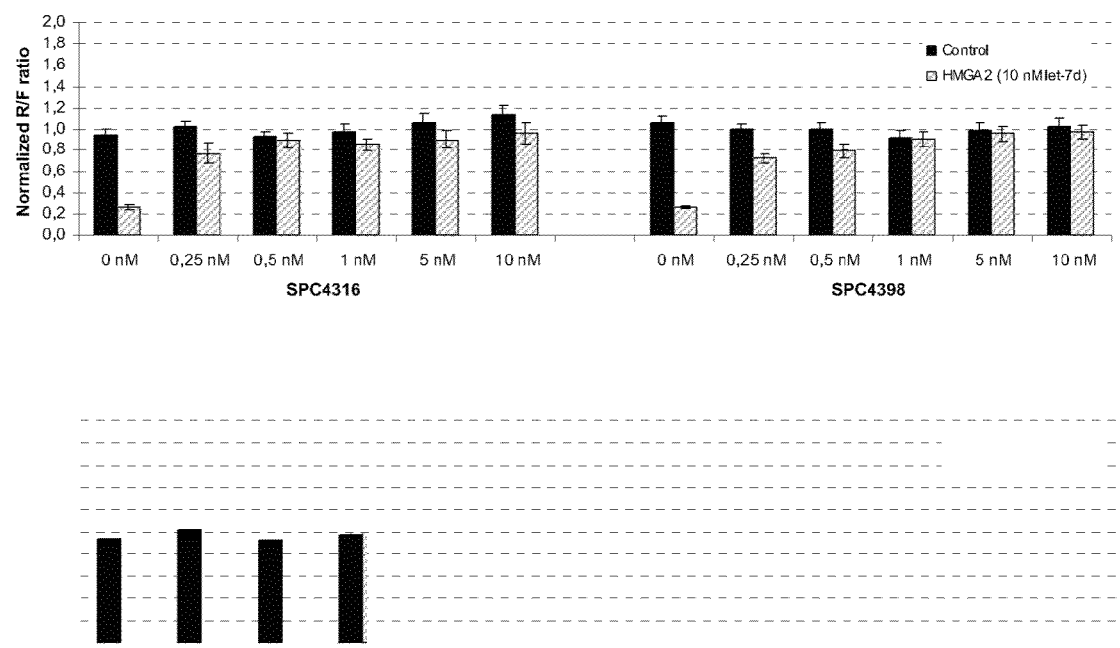

FIG. 29. Luciferase results from Huh-7 cells transfected with the HMGA2 3'UTR sensor plasmid, LNA-antimiRs Compound 3226 (SEQ ID NO: 24) (left) and Compound 3227 (SEQ ID NO: 25) (right), and pre-miRs for let-7a (A), let-7d (B), let-7e (C), and let-7I (D). Grey bars indicate the target de-repression after pre-mis inclusion, whereas black control bars represent the equivalent level without pre-miR addition. Each ratio is based on quadruplicate measurements and have been normalized against the average of wells containing no precursor (black bars) within each treatment group.

Figure 30:
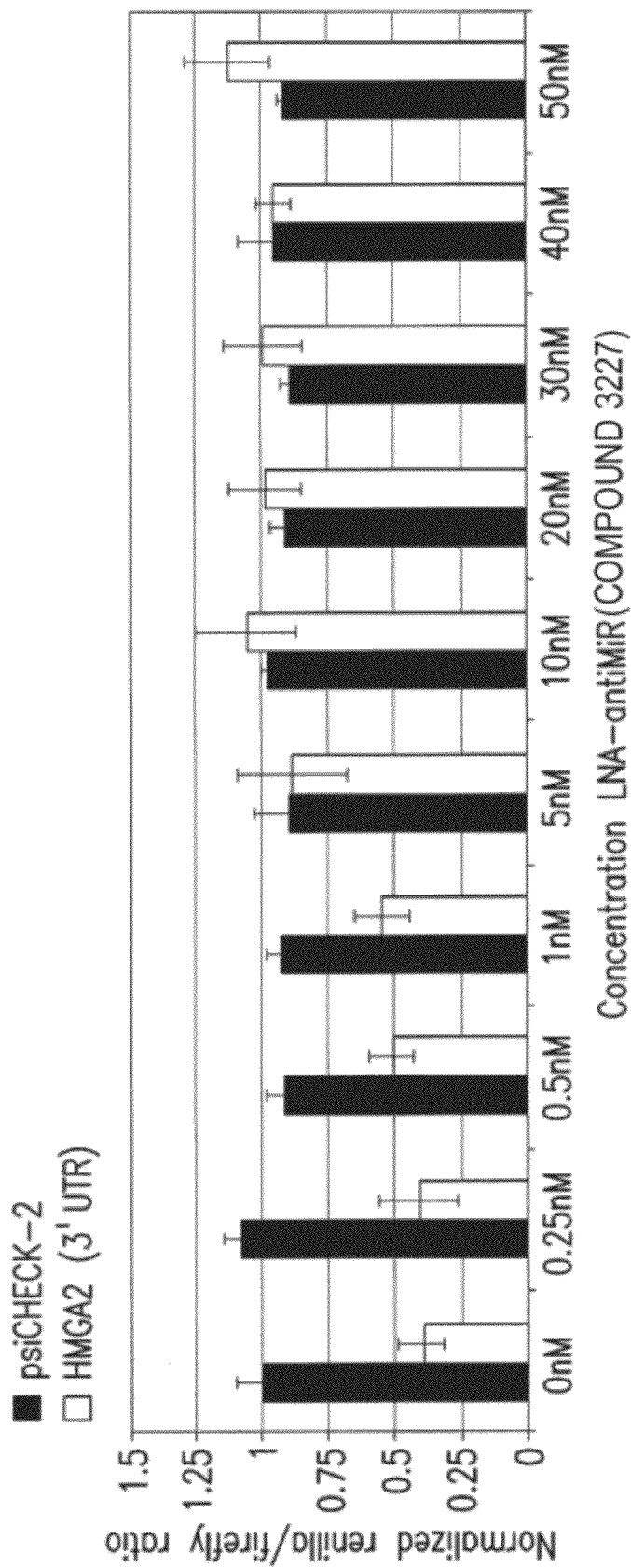

FIG. 30. Luciferase results from HeLa cells transfected with the HMGA2 3'UTR sensor plasmid or control vector, and the LNA-antimiR Compound 3227 (SEQ ID NO: 25) at various concentrations. Each ratio is based on quadruplicate measurements normalized against untreated (0 nM) empty control vector (psi-CHECK-2; grey bars).

Figure 31:
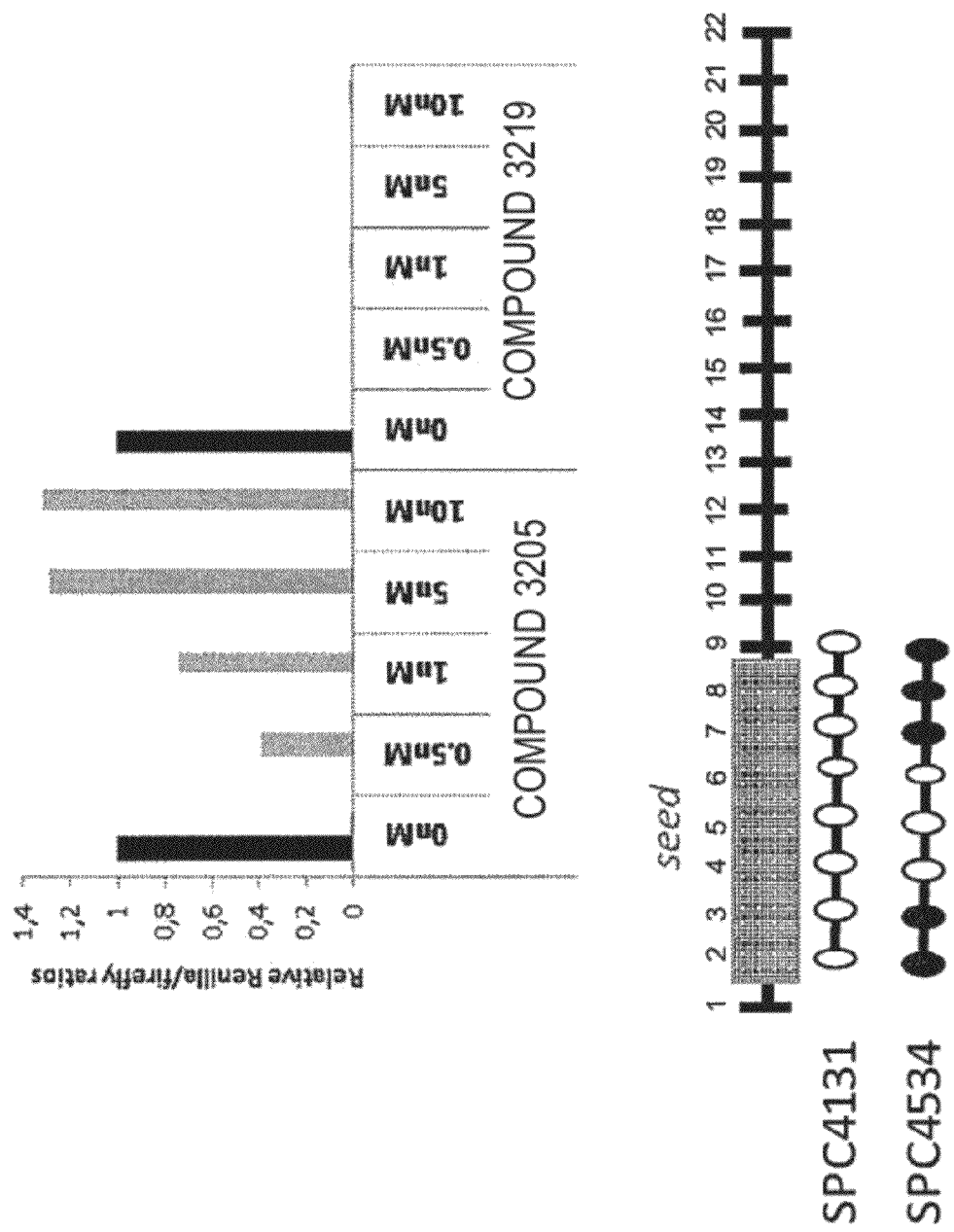

FIG. 31. Assessment of miR-21 antagonism by 8 mer Compound 3205 (SEQ ID NO: 2) in HCT116 cells using a luciferase sensor assay. HCT116 cells were co-transfected with luciferase sensor plasmids containing a perfect match target site for miR-21 (grey bars) and LNA-antimiR and control oigonucleotides at different concentrations. After 24 hours, cells were harvested and luciferase activity measured. Shown is one typical example of two where the *renilla*/firefly ratios have been normalized against 0 nM empty vector (=black bars).

Figure 32:
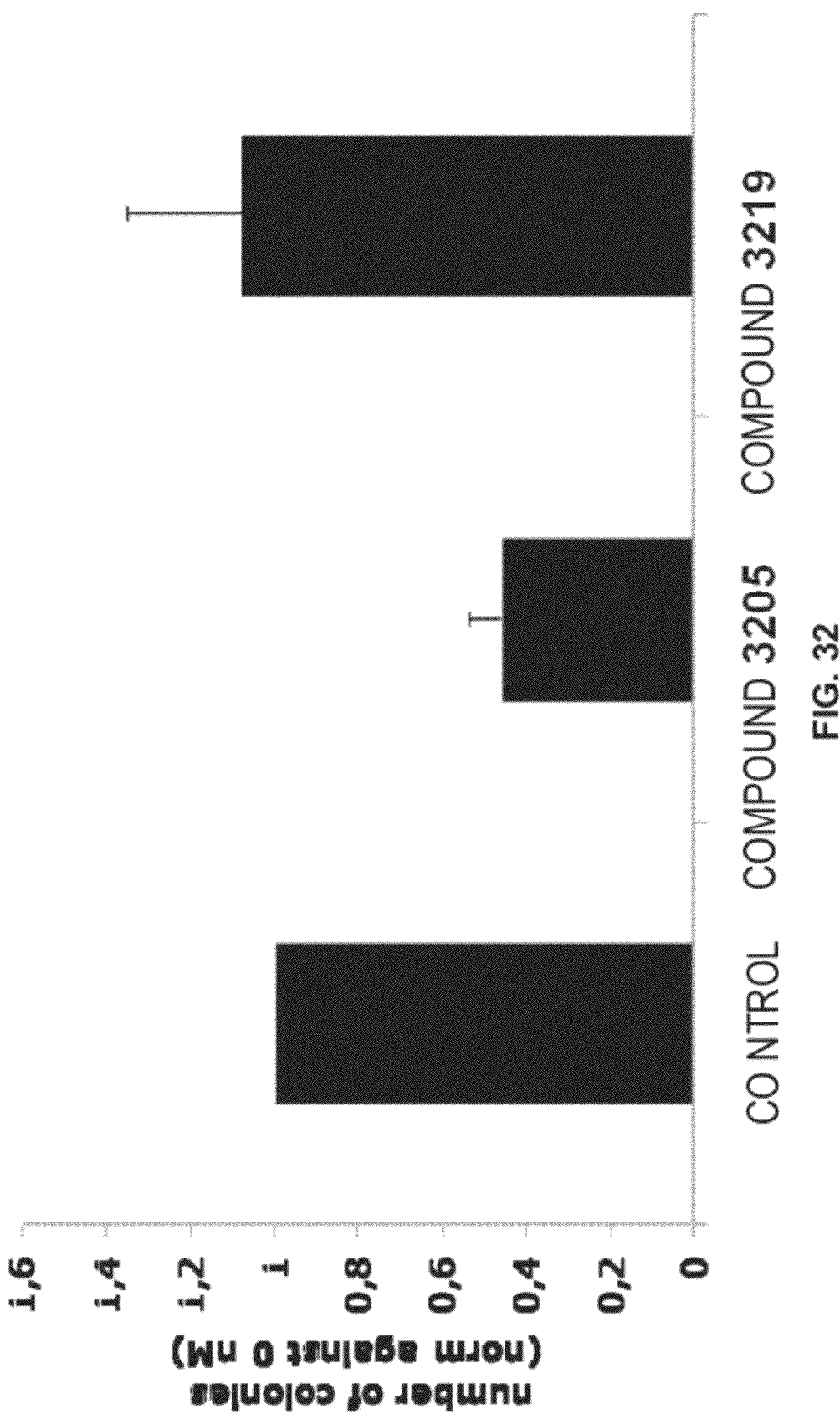

FIG. 32. Silencing of miR-21 by the 8-mer Compound 3205 (SEQ ID NO: 2) LNA-antimiR reduces colony formation in soft agar in PC3 cells. PC3 cells were transfected with 25 nM of the 8-mer LNA-antimiR Compound 3205 (SEQ ID NO: 2) targeting miR-21. After 24 hours, cells were harvested and seeded on soft agar. After 12 days, colonies were counted. Shown is the mean of three separate experiments, each performed in triplicate, and normalised against 0 nM control (i.e. transfection but with no LNA). p=0.01898 for Compound 3205 (SEQ ID NO: 2).

Figure 33:
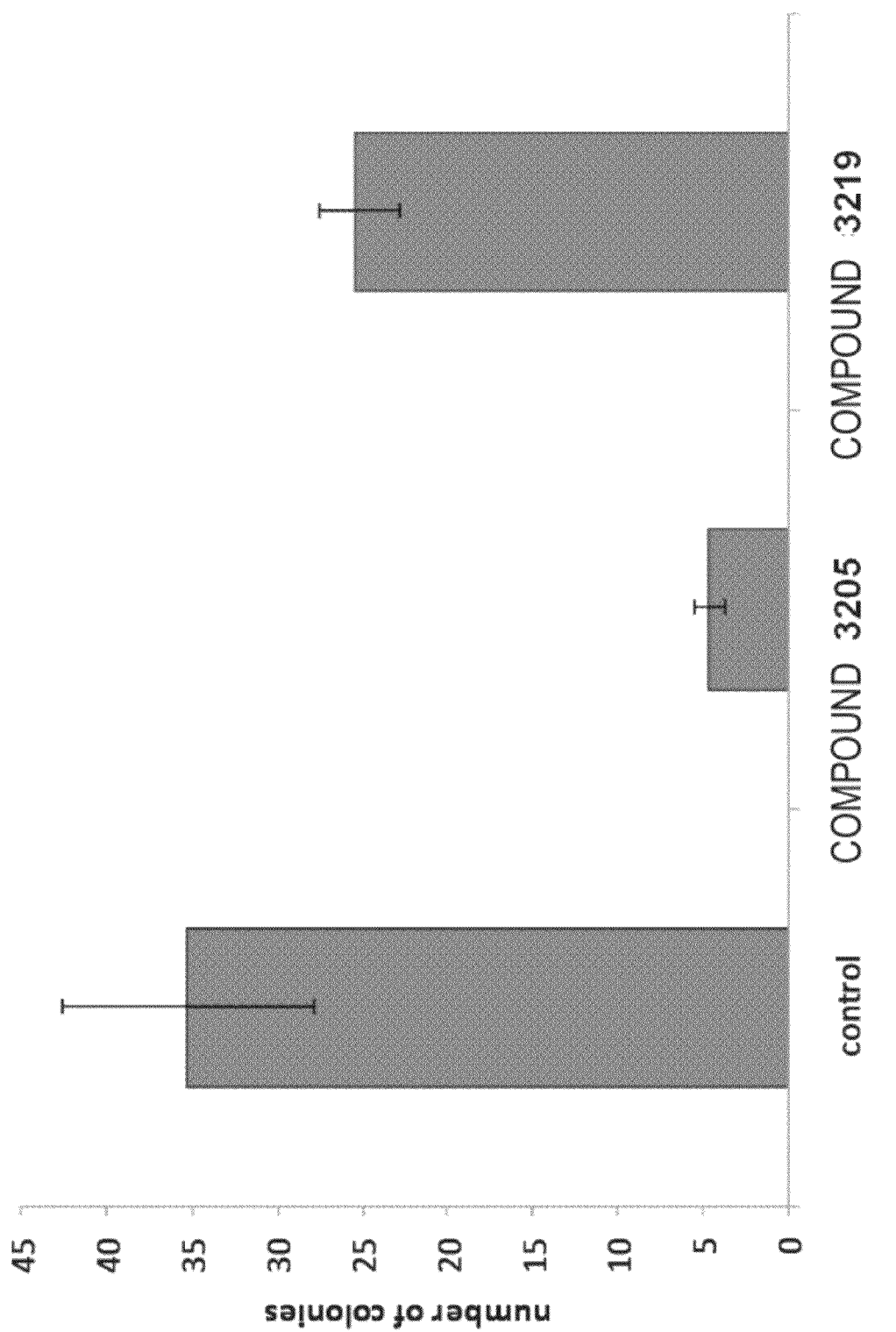

FIG. 33. Knock-down of miR-21 by the 8-mer Compound 3205 (SEQ ID NO: 2) LNA-antimiR reduces colony formation in soft agar in HepG2 cells. HepG2 cells were transfected with 25 nM of the 8-mer LNA-antimiR Compound 3205 (SEQ ID NO: 2) targeting miR-21. After 24 hours, cells were harvested and seeded on soft agar. After 17 days, colonies were counted. Shown is the mean of three replicates from one experiment (bars=SEM).

FIG. 34. Wound closure in the invasive human prostate cell line PC3 after treatment with Compound 3205 (SEQ ID NO: 2). (A) PC3 cells were transfected at day 3 with LNA-antimiR and control oligonucleotides at 25 nM, Compound 3205 (SEQ ID NO: 2) (8 mer, perfect match) and Compound 3219 (SEQ ID NO: 17) (8 mer, mismatch) and the following day a scratch was made. Pictures were taken after 24 hours in order to monitor the migration. (B) The area in each timepoint has been measured with the software program Image J and normalized against respective 0 h time-point.

Figure 35:
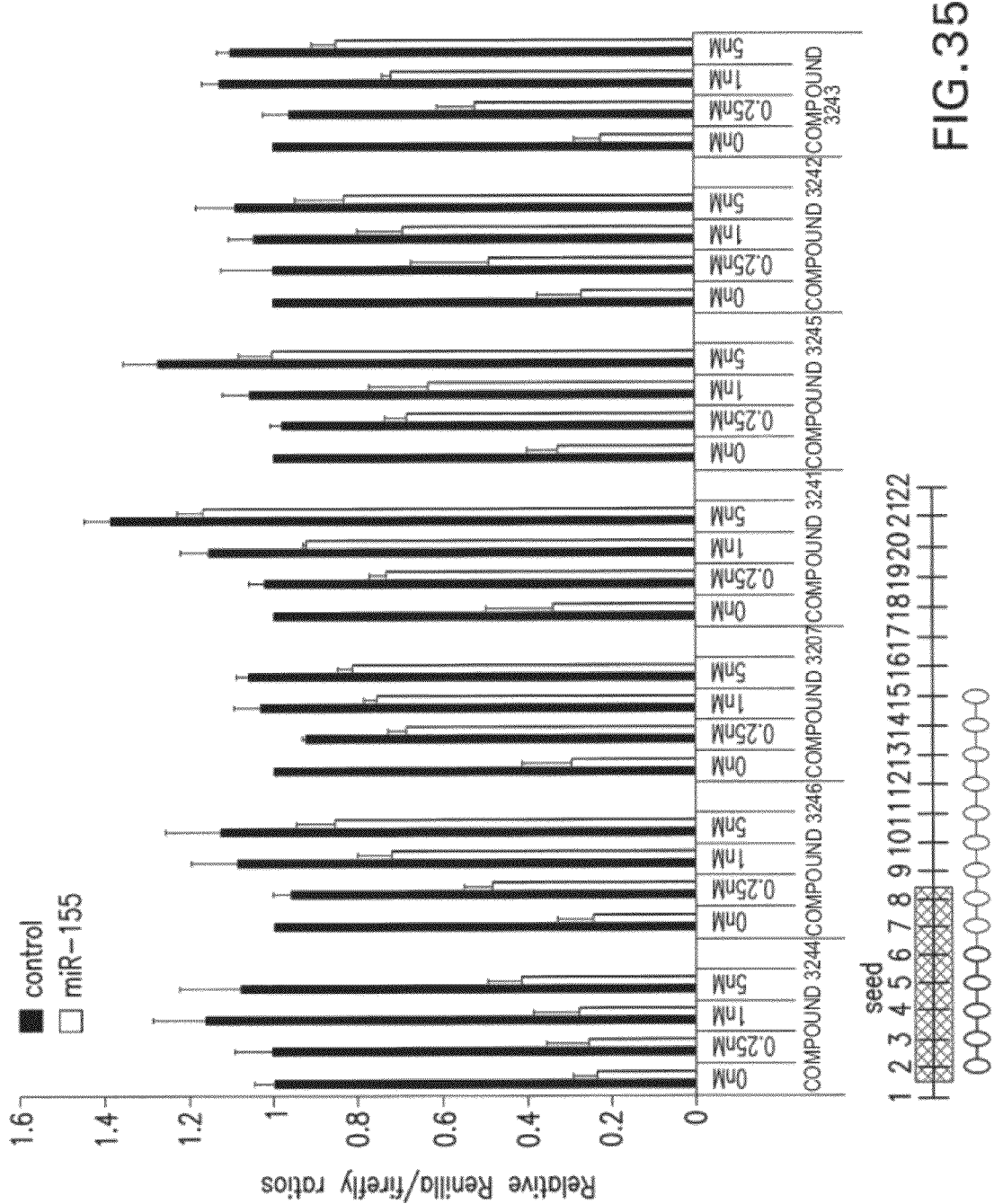

FIG. 35. Length assessment of fully LNA-substituted LNA-antimiRs antagonizing miR-155. RAW cells were co-transfected with luciferase reporter plasmids containing a perfect match target site for miR-155 and with LNA-antimiR oligonucleotides at different concentrations. After 24 hours, cells were harvested and luciferase activity measured. Shown are the mean values (bars=s.e.m) for three independent experiments where the *renilla*/firefly ratios have been normalized against 0 nM empty vector without target site (=mock). Shown is also a schematic presentation of the miR sequence and the design and position of the LNA-antimiRs.

FIG. 36. Binding of 5'-FAM labeled LNA-antimiR-21 Compound 3205 (SEQ ID NO: 2) to mouse plasma protein.

(A) % unbound LNA-antimiR-21 compound as a function of oligonucleotide concentration in mouse plasma. (B) Concentration of unbound LNA-antimiR-21 Compound 3205 (SEQ ID NO: 2) as a function of Compound 3205 (SEQ ID NO: 2) concentration in mouse plasma.

FIG. 37. Quantification Ras protein levels by Western blot analysis. A. Gel image showing Ras and Tubulin (internal standard) protein in treated (anti-let-7; 8-mer) vs. untreated (saline) lung and kidney samples. B. Quantifications of Ras protein levels in the lung and kidney, respectively, of LNA-antimiR-treated mice (black bars), normalized against equivalent saline controls (grey bars), using tubulin as equal-loading control.

FIG. 38. Silencing of miR-21 by Compound 3205 (SEQ ID NO: 2) leads to increased levels of Pdcd4 protein levels in vivo. Mice were injected with saline or 25 mg/kg LNA-antimiR Compound 3205 (SEQ ID NO: 2) over 14 days every other day, with a total of 5 doses. Mice were sacrificed and protein was isolated from kidney and subjected to Western blot analysis with Pdcd4 antibody. A. Gel image showing Pdcd4 and Gapdh (internal standard) protein in treated (anti-miR-21; 8-mer) vs. untreated (saline) kidney samples (M1, mouse 1; M2, mouse 2). B. Quantification of Pdcd4 protein levels in kidneys of LNA-antimiR-treated mice (dark grey bars), normalized against the average of equivalent saline controls (light grey bars), using Gapdh as loading control.

DETAILED DESCRIPTION OF THE INVENTION

Short oligonucleotides which incorporate LNA are known from the in vitro reagents area, (see for example WO2005/098029 and WO 2006/069584). However the molecules designed for diagnostic or reagent use are very different in design than those for in vivo or pharmaceutical use. For example, the terminal nucleotides of the reagent oligos are typically not LNA, but DNA, and the internucleoside linkages are typically other than phosphorothioate, the preferred linkage for use in the oligonucleotides of the present invention. The invention therefore provides for a novel class of oligonucleotides (referred to herein as oligomers) per se.

The following embodiments refer to certain embodiments of the oligomer of the invention, which may be used in a pharmaceutical composition. Aspects which refer to the oligomer may also refer to the contiguous nucleotide sequence, and vice versa.

The Oligomer

The oligomer of the invention is a single stranded oligonucleotide which comprises nucleotide analogues, such as LNA, which form part of, or the entire contiguous nucleotide sequence of the oligonucleotide. The nucleotide sequence of the oligomer consists of a contiguous nucleotide sequence.

The term "oligonucleotide" (or simply "oligo"), which is used interchangeably with the term "oligomer" refers, in the context of the present invention, to a molecule formed by covalent linkage of two or more nucleotides. When used in the context of the oligonucleotide of the invention (also referred to the single stranded oligonucleotide), the term "oligonucleotide" may have, in one embodiment, for example have between 7-10 nucleotides, such as in individual embodiments, 7, 8, 9, or 10.

The term 'nucleotide' refers to nucleotides, such as DNA and RNA, and nucleotide analogues. It should be recognised that, in some aspects, the term nucleobase may also be used to refer to a nucleotide which may be either naturally occurring or non-naturally occurring—in this respect the term nucleobase and nucleotide may be used interchangeably herein.

In some embodiments, the contiguous nucleotide sequence consists of 7 nucleotide analogues. In some embodiments, the contiguous nucleotide sequence consists of 8 nucleotide analogues. In some embodiments, the contiguous nucleotide sequence consists of 9 nucleotide analogues.

In one embodiment at least about 50% of the nucleotides of the oligomer are nucleotide analogues, such as at least about 55%, such as at least about 60%, or at least about 65% or at least about 70%, such as at least about 75%, such as at least about 80%, such as at least about 85%, such as at least about 90%, such as at least about 95% or such as 100%. It will also be apparent that the oligonucleotide may comprise of a nucleotide sequence which consists of only nucleotide analogues. Suitably, the oligomer may comprise at least one LNA monomer, such as 2, 3, 4, 5, 6, 7, 8, 9 or 10 LNA monomers. As described below, the contiguous nucleotide sequence may consist only of LNA units (including linkage groups, such as phosphorothioate linkages), or may consist of LNA and DNA units, or LNA and other nucleotide analogues. In some embodiments, the contiguous nucleotide sequence comprises either one or two DNA nucleotides, the remainder of the nucleotides being nucleotide analogues, such as LNA unit.

In some embodiments, the contiguous nucleotide sequence consists of 6 nucleotide analogues and a single DNA nucleotide. In some embodiments, the contiguous nucleotide consists of 7 nucleotide analogues and a single DNA nucleotide. In some embodiments, the contiguous nucleotide sequence consists of 8 nucleotide analogues and a single DNA nucleotide. In some embodiments, the contiguous nucleotide sequence consists of 9 nucleotide analogues and a single DNA nucleotide. In some embodiments, the contiguous nucleotide sequence consists of 7 nucleotide analogues and two DNA nucleotides. In some embodiments, the contiguous nucleotide sequence consists of 8 nucleotide analogues and two DNA nucleotides.

The oligomer may consist of the contiguous nucleotide sequence.

In a specially preferred embodiment, all the nucleotide analogues are LNA. In a further preferred embodiment, all nucleotides of the oligomer are LNA. In a further preferred embodiment, all nucleotides of the oligomer are LNA and all internucleoside linkage groups are phosphothioate.

Herein, the term "nitrogenous base" is intended to cover purines and pyrimidines, such as the DNA nucleobases A, C, T and G, the RNA nucleobases A, C, U and G, as well as non-DNA/RNA nucleobases, such as 5-methylcytosine ($^{Me}C$), isocytosine, pseudoisocytosine, 5-bromouracil, 5-propynyluracil, 5-propyny-6-fluorouracil, 5-methylthiazoleuracil, 6-aminopurine, 2-aminopurine, inosine, 2,6-diaminopurine, 7-propyne-7-deazaadenine, 7-propyne-7-deazaguanine and 2-chloro-6-aminopurine, in particular $^{Me}C$. It will be understood that the actual selection of the non-DNA/RNA nucleobase will depend on the corresponding (or matching) nucleotide present in the microRNA strand which the oligonucleotide is intended to target. For example, in case the corresponding nucleotide is G it will normally be necessary to select a non-DNA/RNA nucleobase which is capable of establishing hydrogen bonds to G. In this specific case, where the corresponding nucleotide is G, a typical example of a preferred non-DNA/RNA nucleobase is $^{Me}C$.

It should be recognised that the term in 'one embodiment' should not necessarily be limited to refer to one specific embodiment, but may refer to a feature which may be present in 'some embodiments', or even as a generic feature of the invention. Likewise, the use of the term 'some embodiments' may be used to describe a feature of one specific embodiment, or a collection of embodiments, or even as a generic feature of the invention.

The terms "corresponding to" and "corresponds to" refer to the comparison between the nucleotide sequence of the oligomer or contiguous nucleotide sequence (a first sequence) and the equivalent contiguous nucleotide sequence of a further sequence selected from either i) a sub-sequence of the reverse complement of the microRNA nucleic acid target (such as a microRNA target selected from SEQ ID NO:40 to SEQ ID NO:976, and/or ii) the sequence of 9-mer, 8-mer and 7-mer nucleotides provided herein in Table 1. Nucleotide analogues are compared directly to their equivalent or corresponding nucleotides. A first sequence which corresponds to a further sequence under i) or ii) typically is identical to that sequence over the length of the first sequence (such as the contiguous nucleotide sequence).

When referring to the length of a nucleotide molecule as referred to herein, the length corresponds to the number of monomer units, i.e. nucleotides, irrespective as to whether those monomer units are nucleotides or nucleotide analogues.

With respect to nucleotides or nucleobases, the terms monomer and unit are used interchangeably herein.

It should be understood that when the term "about" is used in the context of specific values or ranges of values, the disclosure should be read as to include the specific value or range referred to.

As used herein, "hybridisation" means hydrogen bonding, which may be Watson-Crick, Hoogsteen, reversed Hoogsteen hydrogen bonding, etc., between complementary nucleoside or nucleotide bases. The four nucleobases commonly found in DNA are G, A, T and C of which G pairs with C, and A pairs with T. In RNA T is replaced with uracil (U), which then pairs with A. The chemical groups in the nucleobases that participate in standard duplex formation constitute the Watson-Crick face. Hoogsteen showed a couple of years later that the purine nucleobases (G and A) in addition to their Watson-Crick face have a Hoogsteen face that can be recognised from the outside of a duplex, and used to bind pyrimidine oligonucleotides via hydrogen bonding, thereby forming a triple helix structure.

In the context of the present invention "complementary" refers to the capacity for precise pairing between two nucleotides sequences with one another. For example, if a nucleotide at a certain position of an oligonucleotide is capable of hydrogen bonding with a nucleotide at the corresponding position of a DNA or RNA molecule, then the oligonucleotide and the DNA or RNA are considered to be complementary to each other at that position. The DNA or RNA strand are considered complementary to each other when a sufficient number of nucleotides in the oligonucleotide can form hydrogen bonds with corresponding nucleotides in the target DNA or RNA to enable the formation of a stable complex. To be stable in vitro or in vivo the sequence of an oligonucleotide need not be 100% complementary to its target microRNA. The terms "complementary" and "specifically hybridisable" thus imply that the oligonucleotide binds sufficiently strong and specific to the target molecule to provide the desired interference with the normal function of the target whilst leaving the function of non-target RNAs unaffected. However, in one preferred embodiment the term complementary shall mean 100% complementary or fully complementary.

In a preferred example the oligonucleotide of the invention is 100% complementary to a miRNA sequence, such as a human microRNA sequence, or one of the microRNA sequences referred to herein.

In a preferred example, the oligonucleotide of the invention comprises a contiguous sequence, which is 100% complementary to the seed region of the human microRNA sequence.

Preferably, the term "microRNA" or "miRNA", in the context of the present invention, means an RNA oligonucleotide consisting of between 18 to 25 nucleotides in length. In functional terms miRNAs are typically regulatory endogenous RNA molecules.

The terms "target microRNA" or "target miRNA" refer to a microRNA with a biological role in human disease, e.g. an upregulated, oncogenic miRNA or a tumor suppressor miRNA in cancer, thereby being a target for therapeutic intervention of the disease in question.

The terms "target gene" or "target mRNA" refer to regulatory mRNA targets of microRNAs, in which said "target gene" or "target mRNA" is regulated post-transcriptionally by the microRNA based on near-perfect or perfect complementarity between the miRNA and its target site resulting in target mRNA cleavage; or limited complementarity, often conferred to complementarity between the so-called seed sequence (nucleotides 2-7 of the miRNA) and the target site resulting in translational inhibition of the target mRNA.

In the context of the present invention the oligonucleotide is single stranded, this refers to the situation where the oligonucleotide is in the absence of a complementary oligonucleotide—i.e. it is not a double stranded oligonucleotide complex, such as an siRNA. In one embodiment, the composition according of the invention does not comprise a further oligonucleotide which has a region of complementarity with the oligomer of 5 or more, such as 6, 7, 8, 9, or 10 consecutive nucleotides, such as eight or more.

Length

Surprisingly we have found that such short 'antimiRs' provide an improved specific inhibition of microRNAs in vivo, whilst retaining remarkable specificity for the microRNA target. A further benefit has been found to be the ability to inhibit several microRNAs simultaneously due to the conservation of homologous short sequences between microRNA species—such as the seed regions as described herein. According to the present invention, it has been found that it is particularly advantageous to have short oligonucleotides of 7, 8, 9, 10 nucleotides, such as 7, 8 or 9 nucleotides.

Sequences

The contiguous nucleotide sequence is complementary (such as 100% complementary—i.e. perfectly complementary) to a corresponding region of a mammalian, human or viral microRNA (miRNA) sequence, preferably a human or viral miRNA sequence.

The microRNA sequence may suitably be a mature microRNA. In some embodiments the microRNA may be a microRNA precursor.

The human microRNA sequence may be selected from SEQ ID NO:1 to SEQ ID NO: 558 as disclosed in WO2008/046911, which are all hereby and specifically incorporated by reference. As described in WO2008/046911, these microRNAs are associated with cancer.

The viral microRNA sequence may, in some embodiments, be selected from the group consisting of Herpes simplex virus 1, Kaposi sarcoma-associated herpesvirus, Epstein Barr virus and Human cytomegalovirus.

In one embodiment, the contiguous nucleotide sequence is complementary (such as 100% complementary) to a corresponding region of a miRNA sequence selected from the group of miRNAs listed in table 1. Table 1 provides 7-mer, 8-mer and 9-mer oligomers which target human and viral microRNAs published in miRBase (Release 12.0-http://microrna.sanger.ac.uk/sequences/).

In some embodiments, the oligomers according to the invention may consist of or comprise a contiguous nucleotide sequence which is complementary to a corresponding microRNA sequence selected from the group consisting of miR-1, miR-10b, miR-17-3p, miR-18, miR-19a, miR-19b, miR-20, miR-21, miR-34a, miR-93, miR-106a, miR-106b, miR-122, miR-133, miR-134, miR-138, miR-155, miR-192, miR-194, miR-221, miR-222, miR-375.

Therefore, in one embodiment, the miRNA (i.e target miRNA) is selected from the group consisting of miR-1, miR-10b, miR-17-3p, miR-18, miR-19a, miR-19b, miR-20, miR-21, miR-34a, miR-93, miR-106a, miR-106b, miR-122, miR-133, miR-134, miR-138, miR-155, miR-192, miR-194, miR-221, miR-222, and miR-375.

In one embodiment, the miRNA target is a member of the miR 17-92 cluster, such as miR 17, miR 106a, miR 106b, miR 18, miR 19a, miR 19b/1, miR 19b/2, miR 20/93, miR 92/1, miR 92/2 and miR 25.

In some embodiments the contiguous nucleotide sequence is complementary to a corresponding region of a microRNA (miRNA) sequence selected from the group consisting of miR-21, miR-155, miR-221, mir-222, and mir-122.

In some embodiments said miRNA is selected from the group consisting of miR-1, miR-10 miR-29, miR-125b, miR-126, miR-133, miR-141, miR-143, miR-200b, miR-206, miR-208, miR-302, miR-372, miR-373, miR-375, and miR-520c/e.

In some embodiments the contiguous nucleotide sequence is complementary to a corresponding region of a microRNA (miRNA) sequence present in the miR 17-92 cluster, such as a microRNA selected from the group consisting of miR-17-5p, miR-20a/b, miR-93, miR-106a/b, miR-18a/b, miR-19a/b, miR-25, miR-92a, miR-363.

In one embodiment, the miRNA (i.e target miRNA) is miR-21, such as hsa-miR-21 (SEQ ID NO: 410). In one embodiment, the miRNA (i.e target miRNA) is miR-122, such as hsa-miR-122 (SEQ ID NO: 150). In one embodiment, the miRNA (i.e target miRNA) is miR-19b, such as hsa-miR-19b (SEQ ID NO: 389). In one embodiment, the miRNA (i.e target miRNA) is miR-155, such as hsa-miR-155 (SEQ ID NO: 355). In one embodiment, the miRNA (i.e target miRNA) is miR-375, such as hsa-miR-375 (SEQ ID NO: 561). In one embodiment, the miRNA (i.e target miRNA) is miR-375, such as hsa-miR-106b (SEQ ID NO: 124).

Suitably, the contiguous nucleotide sequence may be complementary to a corresponding region of the microRNA, such as a hsa-miR selected from the group consisting of 19b (SEQ ID NO: 389), 21 (SEQ ID NO: 410), 122 (SEQ ID NO: 150), 155 (SEQ ID NO: 355) and 375 (SEQ ID NO: 561).

The Seed Region and Seedmers

The inventors have found that carefully designed short single stranded oligonucleotides comprising or consisting of nucleotide analogues, such as high affinity nucleotide analogues such as locked nucleic acid (LNA) units, show significant silencing of microRNAs, resulting in reduced microRNA levels. It was found that tight binding of said oligonucleotides to the so-called seed sequence, typically nucleotides 2 to 8 or 2 to 7, counting from the 5' end, of the target microRNAs was important. Nucleotide 1 of the target microRNAs is a non-pairing base and is most likely hidden in a binding pocket in the Ago 2 protein. Whilst not wishing to be bound to a specific theory, the present inventors consider that by selecting the seed region sequences, particularly with oligonucleotides that comprise LNA, preferably LNA units in the region which is complementary to the seed region, the duplex between miRNA and oligonucleotide is particularly effective in targeting miRNAs, avoiding off target effects, and possibly providing a further feature which prevents RISC directed miRNA function.

The inventors have found that microRNA silencing is even more enhanced when LNA-modified single stranded oligonucleotides do not contain a nucleotide at the 3' end corresponding to this non-paired nucleotide 1. It was further found that at least two LNA units in the 3' end of the oligonucleotides according to the present invention made said oligonucleotides highly nuclease resistant.

In one embodiment, the first or second 3' nucleotide of the oligomer corresponds to the second 5' nucleotide of the microRNA sequence, and may be a nucleotide analogue, such as LNA.

In one embodiment, nucleotide units 1 to 6 (inclusive) of the oligomer as measured from the 3' end the region of the oligomer are complementary to the microRNA seed region sequence, and may all be nucleotide analogues, such as LNA.

In one embodiment, nucleotide units 1 to 7 (inclusive) of the oligomer as measured from the 3' end the region of the oligomer are complementary to the microRNA seed region sequence, and may all be nucleotide analogues, such as LNA.

In one embodiment, nucleotide units 2 to 7 (inclusive) of the oligomer as measured from the 3' end the region of the oligomer are complementary to the microRNA seed region sequence, and may all be nucleotide analogues, such as LNA.

In one embodiment, the oligomer comprises at least one nucleotide analogue unit, such as at least one LNA unit, in a position which is within the region complementary to the miRNA seed region. The oligomer may, in one embodiment comprise at between one and 6 or between 1 and 7 nucleotide analogue units, such as between 1 and 6 and 1 and 7 LNA units, in a position which is within the region complementary to the miRNA seed region.

In one embodiment, the contiguous nucleotide sequence consists of or comprises a sequence which is complementary (such as 100% complementary) to the seed sequence of said microRNA.

In one embodiment, the contiguous nucleotide sequence consists of or comprises a sequence selected from any one of the seedmer sequences listed in table 1.

In one embodiment, the 3' nucleotide of the seedmer forms the 3' most nucleotide of the contiguous nucleotide sequence, wherein the contiguous nucleotide sequence may, optionally, comprise one or two further nucleotide 5' to the seedmer sequence.

In one embodiment, the oligomer does not comprise a nucleotide which corresponds to the first nucleotide present in the microRNA sequence counted from the 5' end.

In one embodiment, the oligonucleotide according to the invention does not comprise a nucleotide at the 3' end that corresponds to the first 5' end nucleotide of the target microRNA.

Nucleotide Analogues

According to the present invention, it has been found that it is particularly advantageous to have short oligonucleotides of 7, 8, 9, 10 nucleotides, such as 7, 8 or 9 nucleotides, wherein at least 50%, such as 55%, 60%, 65%, 70%, 75%, 80%, 85%, 90%, 95% or such as 100% of the nucleotide units of the oligomer are (preferably high affinity) nucleotide analogues, such as a Locked Nucleic Acid (LNA) nucleotide unit.

In some embodiments, the oligonucleotide of the invention is 7, 8 or 9 nucleotides long, and comprises a contiguous nucleotide sequence which is complementary to a seed region of a human or viral microRNA, and wherein at least 75%, such as at least 80%, such as at least 85%, such as at least 90%, such as at least 95%, such as 100% of the nucleotides are Locked Nucleic Acid (LNA) nucleotide units.

In such oligomers, in some embodiments, the linkage groups are other than phosphodiester linkages, such as are phosphorothioate linkages.

In one embodiment, all of the nucleotide units of the contiguous nucleotide sequence are LNA nucleotide units.

In one embodiment, the contiguous nucleotide sequence comprises or consists of 7, 8, 9 or 10, preferably contiguous, LNA nucleotide units.

In a further preferred embodiment, the oligonucleotide of the invention is 7, 8 or 9 nucleotides long, and comprises a contiguous nucleotide sequence which is complementary to a seed region of a human or viral microRNA, and wherein at least 80% of the nucleotides are LNA, and wherein at least 80%, such as 85%, such as 90%, such as 95%, such as 100% of the internucleotide bonds are phosphorothioate bonds. It will be recognised that the contiguous nucleotide sequence of the oligmer (a seedmer) may extend beyond the seed region.

In some embodiments, the oligonucleotide of the invention is 7 nucleotides long, which are all LNA.

In some embodiments, the oligonucleotide of the invention is 8 nucleotides long, of which up to 1 nucleotide may be other than LNA. In some embodiments, the oligonucleotide of the invention is 9 nucleotides long, of which up to 1 or 2 nucleotides may be other than LNA. In some embodiments, the oligonucleotide of the invention is 10 nucleotides long, of which 1, 2 or 3 nucleotides may be other than LNA. The nucleotides 'other than LNA, may for example, be DNA, or a 2' substituted nucleotide analogues.

High affinity nucleotide analogues are nucleotide analogues which result in oligonucleotides which has a higher thermal duplex stability with a complementary RNA nucleotide than the binding affinity of an equivalent DNA nucleotide. This may be determined by measuring the $T_m$.

In some embodiments, the nucleotide analogue units present in the contiguous nucleotide sequence are selected, optionally independently, from the group consisting of 2'-O_alkyl-RNA unit, 2'-OMe-RNA unit, 2'-amino-DNA unit, 2'-fluoro-DNA unit, LNA unit, PNA unit, HNA unit, INA unit, and a 2'MOE RNA unit.

In some embodiments, the nucleotide analogue units present in the contiguous nucleotide sequence are selected, optionally independently, from the group consisting of 2'-O_alkyl-RNA unit, 2'-OMe-RNA unit, 2'-amino-DNA unit, 2'-fluoro-DNA unit, LNA unit, and a 2'MOE RNA unit.

The term 2' fluoro-DNA refers to a DNA analogue with a substitution to fluorine at the 2' position (2'F). 2' fluoro-DNA is a preferred form of 2' fluoro-nucleotide.

In some embodiments, the oligomer comprises at least 4 nucleotide analogue units, such as at least 5 nucleotide analogue units, such as at least 6 nucleotide analogue units, such as at least 7 nucleotide analogue units, such as at least 8 nucleotide analogue units, such as at least 9 nucleotide analogue units, such as 10, nucleotide analogue units.

In one embodiment, the oligomer comprises at least 3 LNA units, such as at least 4 LNA units, such as at least 5 LNA units, such as at least 6 LNA units, such as at least 7 LNA units, such as at least 8 LNA units, such as at least 9 LNA units, such as 10 LNA.

In one embodiment wherein at least one of the nucleotide analogues, such as LNA units, is either cytosine or guanine, such as between 1-10 of the of the nucleotide analogues, such as LNA units, is either cytosine or guanine, such as 2, 3, 4, 5, 6, 7, 8, or 9 of the of the nucleotide analogues, such as LNA units, is either cytosine or guanine.

In one embodiment at least two of the nucleotide analogues such as LNA units are either cytosine or guanine. In one embodiment at least three of the nucleotide analogues such as LNA units are either cytosine or guanine. In one embodiment at least four of the nucleotide analogues such as LNA units are either cytosine or guanine. In one embodiment at least five of the nucleotide analogues such as LNA units are either cytosine or guanine. In one embodiment at least six of the nucleotide analogues such as LNA units are either cytosine or guanine. In one embodiment at least seven of the nucleotide analogues such as LNA units are either cytosine or guanine. In one embodiment at least eight of the nucleotide analogues such as LNA units are either cytosine or guanine.

In a preferred embodiment the nucleotide analogues have a higher thermal duplex stability for a complementary RNA nucleotide than the binding affinity of an equivalent DNA nucleotide to said complementary RNA nucleotide.

In one embodiment, the nucleotide analogues confer enhanced serum stability to the single stranded oligonucleotide.

Whilst the specific SEQ IDs in the sequence listing and table 1 refer to oligomers of LNA monomers with phosphorothioate (PS) backbone, it will be recognised that the invention also encompasses the use of other nucleotide analogues and/or linkages, either as an alternative to, or in combination with LNA. As such, the sequence of nucleotides (bases) shown in the sequence listings may be of LNA such as LNA/PS, LNA or may be oligomers containing alternative backbone chemistry, such as sugar/linkage chemistry, whilst retaining the same base sequence (A, T, C or G).

Whilst it is envisaged that other nucleotide analogues, such as 2'-MOE RNA or 2'-fluoro nucleotides may be useful in the oligomers according to the invention, it is preferred that the oligomers have a high proportion, such as at least 50%, LNA. nucleotides. The nucleotide analogue may be a DNA analogue such as a DNA analogue where the 2'-H group is substituted with a substitution other than —OH(RNA) e.g. by substitution with —O—CH$_3$, —O—CH$_2$—CH$_2$—O—CH$_3$, —O—CH$_2$—CH$_2$—CH$_2$—NH$_2$, —O—CH$_2$—CH$_2$—CH$_2$—OH or —F. The nucleotide analogue may be a RNA analogues such as a RNA analogue which have been modified in its 2'-OH group, e.g. by substitution with a group other than —H (DNA), for example —O—CH$_3$, —O—CH$_2$—CH$_2$—O—CH$_3$, —O—CH$_2$—CH$_2$—CH$_2$—NH$_2$, —O—CH$_2$—CH$_2$—CH$_2$—OH or —F. In one embodiment the nucleotide analogue is "ENA".

LNA

When used in the present context, the terms "LNA unit", "LNA monomer", "LNA residue", "locked nucleic acid unit", "locked nucleic acid monomer" or "locked nucleic acid residue", refer to a bicyclic nucleoside analogue. LNA units are described in inter alia WO 99/14226, WO 00/56746, WO 00/56748, WO 01/25248, WO 02/28875, WO 03/006475 and WO 03/095467. The LNA unit may also be defined with respect to its chemical formula. Thus, an "LNA unit", as used herein, has the chemical structure shown in Scheme 1 below:

Scheme 1

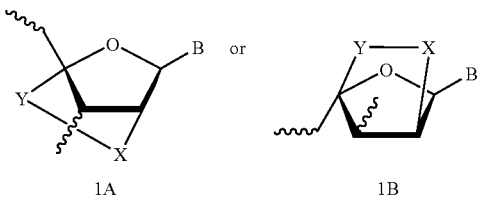

1A          1B wherein
X is selected from the group consisting of O, S and NR$^H$, where R$^H$ is H or C$_{1-4}$-alkyl; Y is (—CH$_2$)$_r$, where r is an integer of 1-4; and B is a nitrogenous base.

In a preferred embodiment of the invention, r is 1 or 2, in particular 1, i.e. a preferred LNA unit has the chemical structure shown in Scheme 2 below:

Scheme 2

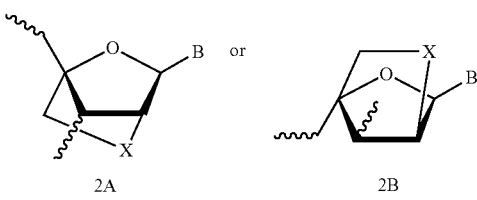

2A          2B wherein X and B are as defined above.

In an interesting embodiment, the LNA units incorporated in the oligonucleotides of the invention are independently selected from the group consisting of thio-LNA units, amino-LNA units and oxy-LNA units.

Thus, the thio-LNA unit may have the chemical structure shown in Scheme 3 below:

Scheme 3

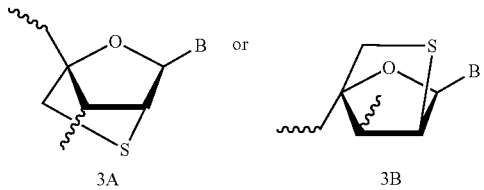

3A          3B wherein B is as defined above.

Preferably, the thio-LNA unit is in its beta-D-form, i.e. having the structure shown in 3A above. likewise, the amino-LNA unit may have the chemical structure shown in Scheme 4 below:

Scheme 4

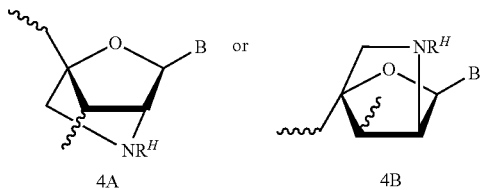

4A          4B wherein B and $R^H$ are as defined above.

Preferably, the amino-LNA unit is in its beta-D-form, i.e. having the structure shown in 4A above.

The oxy-LNA unit may have the chemical structure shown in Scheme 5 below:

Scheme 5

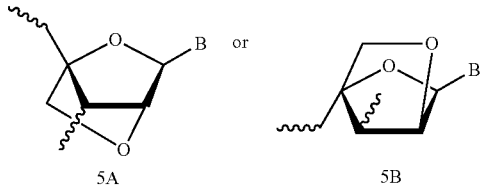

5A          5B wherein B is as defined above.

Preferably, the oxy-LNA unit is in its beta-D-form, i.e. having the structure shown in 5A above. As indicated above, B is a nitrogenous base which may be of natural or non-natural origin. Specific examples of nitrogenous bases include adenine (A), cytosine (C), 5-methylcytosine ($^{Me}$C), isocytosine, pseudoisocytosine, guanine (G), thymine (T), uracil (U), 5-bromouracil, 5-propynyluracil, 5-propyny-6,5-methylthiazoleuracil, 6-aminopurine, 2-aminopurine, inosine, 2,6-diaminopurine, 7-propyne-7-deazaadenine, 7-propyne-7-deazaguanine and 2-chloro-6-aminopurine.

The term "thio-LNA unit" refers to an LNA unit in which X in Scheme 1 is S. A thio-LNA unit can be in both the beta-D form and in the alpha-L form. Generally, the beta-D form of the thio-LNA unit is preferred. The beta-D-form and alpha-L-form of a thio-LNA unit are shown in Scheme 3 as compounds 3A and 3B, respectively.

The term "amino-LNA unit" refers to an LNA unit in which X in Scheme 1 is NH or $NR^H$, where $R^H$ is hydrogen or $C_{1-4}$-alkyl. An amino-LNA unit can be in both the beta-D form and in the alpha-L form. Generally, the beta-D form of the amino-LNA unit is preferred. The beta-D-form and alpha-L-form of an amino-LNA unit are shown in Scheme 4 as compounds 4A and 4B, respectively.

The term "oxy-LNA unit" refers to an LNA unit in which X in Scheme 1 is O. An Oxy-LNA unit can be in both the beta-D form and in the alpha-L form. Generally, the beta-D form of the oxy-LNA unit is preferred. The beta-D form and the alpha-L form of an oxy-LNA unit are shown in Scheme 5 as compounds 5A and 5B, respectively.

In the present context, the term "$C_{1-6}$-alkyl" is intended to mean a linear or branched saturated hydrocarbon chain wherein the longest chains has from one to six carbon atoms, such as methyl, ethyl, n-propyl, isopropyl, n-butyl, isobutyl, sec-butyl, tert-butyl, pentyl, isopentyl, neopentyl and hexyl. A branched hydrocarbon chain is intended to mean a $C_{1-6}$-alkyl substituted at any carbon with a hydrocarbon chain.

In the present context, the term "$C_{1-4}$-alkyl" is intended to mean a linear or branched saturated hydrocarbon chain wherein the longest chains has from one to four carbon atoms, such as methyl, ethyl, n-propyl, isopropyl, n-butyl, isobutyl, sec-butyl and tert-butyl. A branched hydrocarbon chain is intended to mean a $C_{1-4}$-alkyl substituted at any carbon with a hydrocarbon chain.

When used herein the term "$C_{1-6}$-alkoxy" is intended to mean $C_{1-6}$-alkyl-oxy, such as methoxy, ethoxy, n-propoxy, isopropoxy, n-butoxy, isobutoxy, sec-butoxy, tert-butoxy, pentoxy, isopentoxy, neopentoxy and hexoxy.

In the present context, the term "$C_{2-6}$-alkenyl" is intended to mean a linear or branched hydrocarbon group having from two to six carbon atoms and containing one or more double bonds. Illustrative examples of $C_{2-6}$-alkenyl groups include allyl, homo-allyl, vinyl, crotyl, butenyl, butadienyl, pentenyl, pentadienyl, hexenyl and hexadienyl. The position of the unsaturation (the double bond) may be at any position along the carbon chain.

In the present context the term "$C_{2-6}$-alkynyl" is intended to mean linear or branched hydrocarbon groups containing from two to six carbon atoms and containing one or more triple bonds. Illustrative examples of $C_{2-6}$-alkynyl groups include acetylene, propynyl, butynyl, pentynyl and hexynyl. The position of unsaturation (the triple bond) may be at any position along the carbon chain. More than one bond may be unsaturated such that the "$C_{2-6}$-alkynyl" is a di-yne or enediyne as is known to the person skilled in the art.

When referring to substituting a DNA unit by its corresponding LNA unit in the context of the present invention, the term "corresponding LNA unit" is intended to mean that the DNA unit has been replaced by an LNA unit containing the same nitrogenous base as the DNA unit that it has replaced, e.g. the corresponding LNA unit of a DNA unit containing the nitrogenous base A also contains the nitrogenous base A. The exception is that when a DNA unit contains the base C, the corresponding LNA unit may contain the base C or the base $^{Me}$C, preferably $^{Me}$C.

Herein, the term "non-LNA unit" refers to a nucleoside different from an LNA-unit, i.e. the term "non-LNA unit" includes a DNA unit as well as an RNA unit. A preferred non-LNA unit is a DNA unit.

The terms "unit", "residue" and "monomer" are used interchangeably herein.

The term "at least one" encompasses an integer larger than or equal to 1, such as 1, 2, 3, 4, 5, 6, 7, 8, 9, 10, 11, 12, 13, 14, 15, 16, 17, 18, 19, 20 and so forth.

The terms "a" and "an" as used about a nucleotide, an agent, an LNA unit, etc., is intended to mean one or more. In particular, the expression "a component (such as a nucleotide, an agent, an LNA unit, or the like) selected from the group consisting of . . . " is intended to mean that one or more of the cited components may be selected. Thus, expressions like "a component selected from the group consisting of A, B and C" is intended to include all combinations of A, B and C, i.e. A, B, C, A+B, A+C, B+C and A+B+C.

Internucleoside Linkages

The term "internucleoside linkage group" is intended to mean a group capable of covalently coupling together two nucleotides, such as between DNA units, between DNA units and nucleotide analogues, between two non-LNA units, between a non-LNA unit and an LNA unit, and between two LNA units, etc. Examples include phosphate, phosphodiester groups and phosphorothioate groups.

In some embodiments, at least one of, such as all of the internucleoside linkage in the oligomer is phosphodiester. However for in vivo use, phosphorothioate linkages may be preferred.

Typical internucleoside linkage groups in oligonucleotides are phosphate groups, but these may be replaced by internucleoside linkage groups differing from phosphate. In a further interesting embodiment of the invention, the oligonucleotide of the invention is modified in its internucleoside linkage group structure, i.e. the modified oligonucleotide comprises an internucleoside linkage group which differs from phosphate. Accordingly, in a preferred embodiment, the oligonucleotide according to the present invention comprises at least one internucleoside linkage group which differs from phosphate.

Specific examples of internucleoside linkage groups which differ from phosphate (—O—P(O)$_2$—O—) include —O—P(O,S)—O—, —O—P(S)$_2$—O—, —S—P(O)$_2$—O—, —S—P(O,S)—O—, —S—P(S)$_2$—O—, —O—P(O)$_2$—S—, —O—P(O,S)—S—, —S—P(O)$_2$—S—, —O—PO(R$^H$)—O—, O—PO(OCH$_3$)—O—, —O—PO(NR$^H$)—O—, —O—PO(OCH$_2$CH$_2$S—R)—O—, —O—PO(BH$_3$)—O—, —O—PO(NHR$^H$)—O—, —O—P(O)$_2$—NR$^H$—, —NR$^H$—P(O)$_2$—O—, —NR$^H$—CO—O—, —NR$^H$—CO—NR$^H$—, —O—CO—O—, —O—CO—NR$^H$—, —NR$^H$—CO—CH$_2$—, —O—CH$_2$—CO—NR$^H$—, —O—CH$_2$—CH$_2$—NR$^H$—, —CO—NR$^H$—CH$_2$—, —CH$_2$—NR$^H$—CO—, —O—CH$_2$—CH$_2$—S—, —S—CH$_2$—CH$_2$—O—, —S—CH$_2$—CH$_2$—S—, —CH$_2$—SO$_2$—CH$_2$—, —CH$_2$—CO—NR$^H$—, —O—CH$_2$—CH$_2$—NR$^H$—CO —, —CH$_2$—NCH$_3$—O—CH$_2$—, where R$^H$ is hydrogen or C$_{1-4}$-alkyl.

When the internucleoside linkage group is modified, the internucleoside linkage group is preferably a phosphorothioate group (—O—P(O,S)—O—). In a preferred embodiment, all internucleoside linkage groups of the oligonucleotides according to the present invention are phosphorothioate.

The internucleoside linkage may be selected form the group consisting of: —O—P(O)$_2$—O—, —O—P(O,S)—O—, —O—P(S)$_2$—O—, —S—P(O)$_2$—O—, —S—P(O,S)—O—, —S—P(S)$_2$—O—, —O—P(O)$_2$—S—, —O—P(O,S)—S—, —S—P(O)$_2$—S—, —O—PO(R$^H$)—O—, O—PO(OCH$_3$)—O—, —O—PO(NR$^H$)—O—, —O—PO(OCH$_2$CH$_2$S—R)—O—, —O—PO(BH$_3$)—O—, —O—PO(NHR$^H$)—O—, —O—P(O)$_2$—NR$^H$—, —NR$^H$—P(O)$_2$—O—, —NR$^H$—CO—O—, —NR$^H$—CO—NR$^H$—, and/or the internucleoside linkage may be selected form the group consisting of: —O—CO—O—, —O—CO—NR$^H$—, —NR$^H$—CO—CH$_2$—, —O—CH$_2$—CO—NR$^H$—, —O—CH$_2$—CH$_2$—NR$^H$—, —CO—NR$^H$—CH$_2$—, —CH$_2$—NR$^H$—CO—, —O—CH$_2$—CH$_2$—S—, —S—CH$_2$—CH$_2$—O—, —S—CH$_2$—CH$_2$—S—, —CH$_2$—SO$_2$—CH$_2$—, —CH$_2$—CO—NR$^H$—, —O—CH$_2$—CH$_2$—NR$^H$—CO —, —CH$_2$—NCH$_3$—O—CH$_2$—, where R$^H$ is selected from hydrogen and C$_{1-4}$-alkyl.

Suitably, in some embodiments, sulphur (S) containing internucleoside linkages as provided above may be preferred. The internucleoside linkages may be independently selected, or all be the same, such as phosphorothioate linkages.

In one embodiment, at least 75%, such as 80% or 85% or 90% or 95% or all of the internucleoside linkages present between the nucleotide units of the contiguous nucleotide sequence are phosphorothioate internucleoside linkages.

MicromiR Oligonucleotides Targeting More than One MicroRNA

In one embodiment, the contiguous nucleotide sequence is complementary to the corresponding sequence of at least two miRNA sequences such as 2, 3, 4, 5, 6, 7, 8, 9, or 10 miRNA sequence. The use of a single universal base may allow a single oligomer of the invention to target two independant microRNAs which either one or both have a single mismatch in the region which corresponds to oligomer at the position where the universal nucleotide is positioned.

In one embodiment, the contiguous nucleotide sequence consists of or comprises a sequence which is complementary to the sequence of at least two miRNA seed region sequences such as 2, 3, 4, 5, 6, 7, 8, 9, or 10 miRNA seed region sequences.

In one embodiment, the contiguous nucleotide sequence is complementary to the corresponding region of both miR-221 and miR-222.

In one embodiment, the contiguous nucleotide sequence is complementary to the corresponding region of more than one member of the miR-17-92 cluster—such as two or more or all of miR-17-5p, miR-20a/b, miR-93, miR-106a/b; or two or more or all of miR-25, miR-92a and miR-363.

In one embodiment, the contiguous nucleotide sequence consists of or comprises a sequence that is complementary to 5'GCTACAT3'.

Oligomer Design

In one embodiment, the first nucleotide of the oligomer according to the invention, counting from the 3' end, is a nucleotide analogue, such as an LNA unit. In one embodiment, which may be the same or different, the last nucleotide of the oligomer according to the invention, counting from the 3' end, is a nucleotide analogue, such as an LNA unit.

In one embodiment, the second nucleotide of the oligomer according to the invention, counting from the 3' end, is a nucleotide analogue, such as an LNA unit.

In one embodiment, the ninth and/or the tenth nucleotide of the oligomer according to the invention, counting from the 3' end, is a nucleotide analogue, such as an LNA unit.

In one embodiment, the ninth nucleotide of the oligomer according to the invention, counting from the 3' end is a nucleotide analogue, such as an LNA unit.

In one embodiment, the tenth nucleotide of the oligomer according to the invention, counting from the 3' end is a nucleotide analogue, such as an LNA unit.

In one embodiment, both the ninth and the tenth nucleotide of the oligomer according to the invention, calculated from the 3' end is a nucleotide analogue, such as an LNA unit.

In one embodiment, the oligomer according to the invention does not comprise a region of more than 3 consecutive DNA nucleotide units. In one embodiment, the oligomer according to the invention does not comprise a region of more than 2 consecutive DNA nucleotide units.

In one embodiment, the oligomer comprises at least a region consisting of at least two consecutive nucleotide analogue units, such as at least two consecutive LNA units.
In one embodiment, the oligomer comprises at least a region consisting of at least three consecutive nucleotide analogue units, such as at least three consecutive LNA units.
Other Patterns of Nucleotide Analogues such as LNA in the Oligomer Whilst it is envisaged that oligomers containing at least 6 LNA, such as at least 7 nucleotide units may be preferable, the discovery that such short oligomers are highly effective at targeting microRNAs in vivo can be used to prepare shorter oligomers of the invention which comprise other nucleotide analogues, such as high affinity nucleotide analogues. Indeed, the combination of LNA with other high affinity nucleotide analogues are considered as part of the present invention.

Modification of nucleotides in positions 1 to 2, counting from the 3' end. The nucleotide at positions 1 and/or 2 may be a nucleotide analogue, such as a high affinity nucleotide analogue, such as LNA, or a nucleotide analogue selected from the group consisting of 2'-O-alkyl-RNA unit, 2'-OMe-RNA unit, 2'-amino-DNA unit, 2'-fluoro-DNA unit, 2'-MOE-RNA unit, LNA unit, PNA unit, HNA unit, INA unit. The two 3' nucleotide may therefore be Xx, xX, XX or xx, wherein: In one embodiment X is LNA and x is DNA or another nucleotide analogue, such as a 2' substituted nucleotide analogue selected from the group consisting of 2'-O_alkyl-RNA unit, 2'-OMe-RNA unit, 2'-amino-DNA unit, 2'-fluoro-DNA unit, LNA, and a 2'MOE RNA unit. Said non-LNA unit (x) may therefore be 2'MOE RNA or 2'-fluoro-DNA. Alternatively X is a nucleotide analogue, and x is DNA.

The above modification at the 2 3' terminal nucleotides may be combined with modification of nucleotides in positions 3-8 counting from the 3' end, as described below. In this respect nucleotides designated as X and x may be the same throughout the oligomer. It will be noted that when the oligomer is only 7 nucleotides in length the 8$^{th}$ nucleotide counting from the 3' end should be discarded. In the following embodiments which refer to the modification of nucleotides in positions 3 to 8, counting from the 3' end, the LNA units, in one embodiment, may be replaced with other nucleotide anlogues, such as those referred to herein. "X" may, therefore be selected from the group consisting of 2'-O-alkyl-RNA unit, 2'-OMe-RNA unit, 2'-amino-DNA unit, 2'-fluoro-DNA unit, 2'-MOE-RNA unit, LNA unit, PNA unit, HNA unit, INA unit. "x" is preferably DNA or RNA, most preferably DNA. However, it is preferred that X is LNA.

In one embodiment of the invention, the oligonucleotides of the invention are modified in positions 3 to 8, counting from the 3' end. The design of this sequence may be defined by the number of non-LNA units present or by the number of LNA units present. In a preferred embodiment of the former, at least one, such as one, of the nucleotides in positions three to eight, counting from the 3' end, is a non-LNA unit. In another embodiment, at least two, such as two, of the nucleotides in positions three to eight, counting from the 3' end, are non-LNA units. In yet another embodiment, at least three, such as three, of the nucleotides in positions three to eight, counting from the 3' end, are non-LNA units. In still another embodiment, at least four, such as four, of the nucleotides in positions three to eight, counting from the 3' end, are non-LNA units. In a further embodiment, at least five, such as five, of the nucleotides in positions three to eight, counting from the 3' end, are non-LNA units. In yet a further embodiment, all six nucleotides in positions three to eight, counting from the 3' end, are non-LNA units.

Alternatively defined, in an embodiment, the oligonucleotide according to the present invention comprises at least three LNA units in positions three to eight, counting from the 3' end. In an embodiment thereof, the oligonucleotide according to the present invention comprises three LNA units in positions three to eight, counting from the 3' end. The substitution pattern for the nucleotides in positions three to eight, counting from the 3' end, may be selected from the group consisting of XXXxxx, xXXXxx, xxXXXx, xxxXXX, XXxXxx, XXxxXx, XXxxxX, xXXxXx, xXXxxX, xxXXxX, XxXXxx, XxxXXx, XxxxXX, xXxXXx, xXxXxX, xxXxXX, xXxXxX and XxXxXx, wherein "X" denotes an LNA unit and "x" denotes a non-LNA unit. In a preferred embodiment, the substitution pattern for the nucleotides in positions three to eight, counting from the 3' end, is selected from the group consisting of XXxXxx, XXxxXx, XXxxxX, xXXxXx, xXXxxX, xxXXxX, XxXXxx, XxxXXx, XxxxXX, xXxXXx, xXxxXX, xxXxXX, xXxXxX and XxXxXx, wherein "X" denotes an LNA unit and "x" denotes a non-LNA unit. In a more preferred embodiment, the substitution pattern for the nucleotides in positions three to eight, counting from the 3' end, is selected from the group consisting of xXXxXx, xXXxxX, xxXXxX, xXxXXx, xXxxXX, xxXxXX and xXxXxX, wherein "X" denotes an LNA unit and "x" denotes a non-LNA unit. In an embodiment, the substitution pattern for the nucleotides in positions three to eight, counting from the 3' end, is xXxXxX or XxXxXx, wherein "X" denotes an LNA unit and "x" denotes a non-LNA unit. In an embodiment, the substitution pattern for the nucleotides in positions three to eight, counting from the 3' end, is xXxXxX, wherein "X" denotes an LNA unit and "x" denotes a non-LNA unit.

In a further embodiment, the oligonucleotide according to the present invention comprises at least four LNA units in positions three to eight, counting from the 3' end. In an embodiment thereof, the oligonucleotide according to the present invention comprises four LNA units in positions three to eight, counting from the 3' end. The substitution pattern for the nucleotides in positions three to eight, counting from the 3' end, may be selected from the group consisting of xxXXXX, xXxXXX, xXXxXX, xXXXxX, xXXXXx, XxxXXX, XxXxXX, XxXXxX, XxXXXx, XXxxxX, XXxXxX, XXxXXx, XXXxxX, XXXxXx and XXXXxx, wherein "X" denotes an LNA unit and "x" denotes a non-LNA unit.

In yet a further embodiment, the oligonucleotide according to the present invention comprises at least five LNA units in positions three to eight, counting from the 3' end. In an embodiment thereof, the oligonucleotide according to the present invention comprises five LNA units in positions three to eight, counting from the 3' end. The substitution pattern for the nucleotides in positions three to eight, counting from the 3' end, may be selected from the group consisting of xXXXXX, XxXXXX, XXxXXX, XXXxXX, XXXXxX and XXXXXx, wherein "X" denotes an LNA unit and "x" denotes a non-LNA unit.

Preferably, the oligonucleotide according to the present invention comprises one or two LNA units in positions three to eight, counting from the 3' end. This is considered advantageous for the stability of the A-helix formed by the oligo: microRNA duplex, a duplex resembling an RNA:RNA duplex in structure.

In yet a further embodiment, the oligonucleotide according to the present invention comprises at least six LNA units in positions three to eight, counting from the 3' end. In an embodiment thereof, the oligonucleotide according to the present invention comprises at from three to six LNA units in positions three to eight, counting from the 3' end, and in addition from none to three other high affinity nucleotide analogues in the same region, such that the total amount of high affinity nucleotide analogues (including the LNA units) amount to six in the region from positions three to eight, counting from the 3' end.

In some embodiments, such as when X is LNA, said non-LNA unit (x) is another nucleotide analogue unit, such as a 2' substituted nucleotide analogue selected from the group consisting of 2'-O_alkyl-RNA unit, 2'-OMe-RNA unit, 2'-amino-DNA unit, 2'-fluoro-DNA unit, LNA, and a 2'MOE RNA unit. Said non-LNA unit (x) may therefore be 2'MOE RNA or 2'-fluoro-DNA.

For oligomers which have 9 or 10 nucleotides, the nucleotide at positions 9 and/or 10 may be a nucleotide analogue, such as a high affinity nucleotide analogue, such as LNA, or a nucleotide analogue selected from the group consisting of 2'-O-alkyl-RNA unit, 2'-OMe-RNA unit, 2'-amino-DNA unit, 2'-fluoro-DNA unit, 2'-MOE-RNA unit, LNA unit, PNA unit, HNA unit, INA unit. The two 5' nucleotides may therefore be Xx, xX, XX or xx, wherein: In one embodiment X is LNA and x is DNA or another nucleotide analogue, such as a 2' substituted nucleotide analogue selected from the group consisting of 2'-O_alkyl-RNA unit, 2'-OMe-RNA unit, 2'-amino-DNA unit, 2'-fluoro-DNA unit, LNA, and a 2'MOE RNA unit. Said non-LNA unit (x) may therefore be 2'MOE RNA or 2'-fluoro-DNA. Alternatively X is a nucleotide analogue, and x is DNA.

The above modification at the 2 5' terminal nucleotides may be combined with modification of nucleotides in positions 3-8 counting from the 3' end, and/or the 2 3' nucleotitides as described above. In this respect nucleotides designated as X and x may be the same throughout the oligomer.

In a preferred embodiment of the invention, the oligonucleotide according to the present invention contains an LNA unit at the 5' end. In another preferred embodiment, the oligonucleotide according to the present invention contains an LNA unit at the first two positions, counting from the 5' end.

In one embodiment, the invention further provides for an oligomer as described in the context of the pharmaceutical composition of the invention, or for use in vivo in an organism, such as a medicament, wherein said oligomer (or contiguous nucleotide sequence) comprises either i) at least one phosphorothioate linkage and/or
ii) at least one 3' terminal LNA unit, and/or iii) at least one 5' terminal LNA unit.

The oligomer may therefore contain at least one phosphorothioate linkage, such as all linkages being phosphorthioates, and at least one 3' terminal LNA unit, and at least one 5' terminal LNA unit.

It is preferable for most therapeutic uses that the oligonucleotide is fully phosphorothiolated—an exception being for therapeutic oligonucleotides for use in the CNS, such as in the brain or spine where phosphorothioation can be toxic, and due to the absence of nucleases, phosphodiester bonds may be used, even between consecutive DNA units.

As referred to herein, other in one aspect of the oligonucleotide according to the invention is that the second 3' nucleotide, and/or the $9^{th}$ and $10^{th}$ (from the 3' end), if present, may also be LNA.

In one embodiment, the oligomer comprises at least five nucleotide analogue units, such as at least five LNA units, in positions which are complementary to the miRNA seed region.

In one embodiment, the nucleotide sequence of the oligomer which is complementary to the sequence of the microRNA seed region, is selected from the group consisting of (X)xXXXXX, (X)XxXXXX, (X)XXxXXX, (X)XXXxXX, (X)XXXXxX and (X)XXXXXx, wherein "X" denotes a nucleotide analogue, such as an LNA unit, (X) denotes an optional nucleotide analogue, such as an LNA unit, and "x" denotes a DNA or RNA nucleotide unit.

In one embodiment, the oligomer comprises six or seven nucleotide analogue units, such as six or seven LNA units, in positions which are complementary to the miRNA seed region.

In one embodiment, the nucleotide sequence of the oligomer which is complementary to the sequence of the microRNA seed region, is selected from the group consisting of XXXXXX, XxXXXXX, XXxXXXX, XXXxXXX, XXXXxXX, XXXXXxX and XXXXXXx, wherein "X" denotes a nucleotide analogue, such as an LNA unit, such as an LNA unit, and "x" denotes a DNA or RNA nucleotide unit.

In one embodiment, the two nucleotide motif at position 7 to 8, counting from the 3' end of the oligomer is selected from the group consisting of xx, XX, xX and Xx, wherein "X" denotes a nucleotide analogue, such as an LNA unit, such as an LNA unit, and "x" denotes a DNA or RNA nucleotide unit.

In one embodiment, the two nucleotide motif at position 7 to 8, counting from the 3' end of the oligomer is selected from the group consisting of XX, xX and Xx, wherein "X" denotes a nucleotide analogue, such as an LNA unit, such as an LNA unit, and "x" denotes a DNA or RNA nucleotide unit.

In one embodiment, the oligomer comprises at 12 nucleotides and wherein the two nucleotide motif at position 11 to 12, counting from the 3' end of the oligomer is selected from the group consisting of xx, XX, xX and Xx, wherein "X" denotes a nucleotide analogue, such as an LNA unit, such as an LNA unit, and "x" denotes a DNA or RNA nucleotide unit.

In one embodiment, the oligomer comprises 12 nucleotides and wherein the two nucleotide motif at position 11 to 12, counting from the 3' end of the oligomer is selected from the group consisting of XX, xX and Xx, wherein "X" denotes a nucleotide analogue, such as an LNA unit, such as an LNA unit, and "x" denotes a DNA or RNA nucleotide unit, such as a DNA unit.

In one embodiment, the oligomer comprises a nucleotide analogue unit, such as an LNA unit, at the 5' end.

In one embodiment, the nucleotide analogue units, such as X, are independently selected form the group consisting of: 2'-O-alkyl-RNA unit, 2'-OMe-RNA unit, 2'-amino-DNA unit, 2'-fluoro-DNA unit, 2'-MOE-RNA unit, LNA unit, PNA unit, HNA unit, INA unit.

In one embodiment, all the nucleotides of the oligomer of the invention are nucleotide analogue units.

In one embodiment, the nucleotide analogue units, such as X, are independently selected form the group consisting of: 2'-OMe-RNA units, 2'-fluoro-DNA units, and LNA units, In one embodiment, the oligomer comprises said at least one LNA analogue unit and at least one further nucleotide analogue unit other than LNA.

In one embodiment, the non-LNA nucleotide analogue unit or units are independently selected from 2'-OMe RNA units and 2'-fluoro DNA units.

In one embodiment, the oligomer consists of at least one sequence XYX or YXY, wherein X is LNA and Y is either a 2'-OMe RNA unit and 2'-fluoro DNA unit.

In one embodiment, the sequence of nucleotides of the oligomer consists of alternative X and Y units.

In one embodiment, the oligomer comprises alternating LNA and DNA units (Xx) or (xX).

In one embodiment, the oligomer comprises a motif of alternating LNA followed by 2 DNA units (Xxx), xXx or xxX.

In one embodiment, at least one of the DNA or non-LNA nucleotide analogue units are replaced with a LNA nucleotide in a position selected from the positions identified as LNA nucleotide units in any one of the embodiments referred to above. In one embodiment, "X" donates an LNA unit.

Further Designs for Oligomers of the Invention

Table 1 below provides non-limiting examples of short microRNA sequences that could advantageously be targeted with an oligonucleotide of the present invention.

The oligonucleotides according to the invention, such as those disclosed in table 1 may, in one embodiment, have a sequence of 7, 8, 9 or 10 LNA nucleotides 5'-3' LLLLLLL (L)(L)(L)(L), or have a sequence of nucleotides selected form the group consisting of, the first 7, 8, 9 or 10 nucleotides of the following motifs:

LdLddL(L)(d)(d)(L)(d)(L)(d)(L)(L), LdLdLL(L)(d)(d)(L)(L)(L)(d)(L)(L), LMLMML(L)(M)(M)(L)(M)(L)(M)(L)(L), LMLMLL(L)(M)(M)(L)(L)(L)(M)(L)(L), LFLFFL(L)(F)(F)(L)(F)(L)(F)(L)(L), LFLFLL(L)(F)(F)(L)(L)(L)(F)(L)(L), and every third designs such as; LddLdd(L)(d)(d)(L)(d)(d)(L)(d)(d)(L)(d)'dLddLd(d)(L)(d)(d)(L)(d)(d)(L)(d)(d)(L), ddLddL(d)(d)(L)(d)(d)(L)(d)(d)(L)(d)(d), LMMLMM(L)(M)(M)(L)(M)(M)(L)(M)(M)(L)(M), MLMMLM(M)(L)(M)(M)(L)(M)(M)(L)(M)(M)(L), MMLMML(M)(M)(L)(M)(M)(L)(M)(M)(L), LFFLFF(L)(F)(F)(L)(F)(F)(L)(F)(F)(L)(F), FLFFLF(F)(L)(F)(F)(L)(F)(F)(L)(F)(F)(L), FFLFFL(F)(F)(L)(F)(F)(L)(F)(F)(L)(F)(F), and dLdLdL(d)(L)(d)(L)(d)(L)(d)(L)(d) and an every second design, such as; LdLdLd(L)(d)(L)(d)(L)(d)(L)(d)(L)(d)(L), MLMLML(M)(L)(M)(L)(M)(L)(M)(L)(M)(L)(M), LMLMLM(L)(M)(L)(M)(L)(M)(L)(M)(L), FLFLFL(F)(L)(F)(L)(F)(L)(F)(L)(F)(L)(F), and LFLFLF(L)(F)(L)(F)(L)(F)(L)(F)(L); wherein L=LNA unit, d=DNA units, M=2'MOE RNA, F=2'Fluoro and residues in brackets are optional.

Pharmaceutical Composition and Medical Application

The invention provides for a pharmaceutical composition comprising the oligomer according to the invention, and a pharmaceutically acceptable diluent, carrier, salt or adjuvant.

The invention further provides for the use of an oligonucleotide according to the invention, such as those which may form part of the pharmaceutical composition, for the manufacture of a medicament for the treatment of a disease or medical disorder associated with the presence or over-expression (upregulation) of the microRNA.

The invention further provides for a method for the treatment of a disease or medical disorder associated with the presence or over-expression of the microRNA, comprising the step of administering a composition (such as the pharmaceutical composition) according to the invention to a person in need of treatment.

The invention further provides for a method for reducing the effective amount of a miRNA in a cell or an organism, comprising administering a composition (such as the pharmaceutical composition) according to the invention or a oligomer according to the invention to the cell or the organism.

Reducing the effective amount in this context refers to the reduction of functional miRNA present in the cell or organism. It is recognised that the preferred oligonucleotides according to the invention may not always significantly reduce the actual amount of miRNA in the cell or organism as they typically form very stable duplexes with their miRNA targets. The reduction of the effective amount of the miRNA in a cell may, in one embodiment, be measured by detecting the level of de-repression of the miRNA's target in the cell.

The invention further provides for a method for de-repression of a target mRNA of a miRNA in a cell or an organism, comprising administering a composition (such as the pharmaceutical composition) or a oligomer according to the invention to the cell or the organism.

The invention further provides for the use of a oligomer of between 7-10 such as 7, 8, 9, or 10 nucleotides in length, for the manufacture of a medicament for the treatment of a disease or medical disorder associated with the presence or over-expression of the microRNA.

In one embodiment the medical condition (or disease) is hepatitis C(HCV), and the miRNA is miR-122.

In one embodiment, the pharmaceutical composition according to the invention is for use in the treatment of a medical disorder or disease selected from the group consisting of: hepatitis C virus infection and hypercholesterolemia and related disorders, and cancers.

In one embodiment the medical disorder or disease is a CNS disease, such as a CNS disease where one or more microRNAs are known to be indicated.

In the context of hypercholesterolemia related disorders refers to diseases such as atherosclerosis or hyperlipidemia. Further examples of related diseases also include different types of HDL/LDL cholesterol imbalance; dyslipidemias, e.g., familial combined hyperlipidemia (FCHL), acquired hyperlipidemia, statin-resistant hypercholesterolemia; coronary artery disease (CAD) coronary heart disease (CHD), atherosclerosis.

In one embodiment, the pharmaceutical composition according to the invention further comprises a second independent active ingredient that is an inhibitor of the VLDL assembly pathway, such as an ApoB inhibitor, or an MTP inhibitor (such as those disclosed in U.S. 60/977,497, hereby incorporated by reference).

The invention further provides for a method for the treatment of a disease or medical disorder associated with the presence or over-expression of the microRNA, comprising the step of administering a composition (such as the pharmaceutical composition) comprising a oligomer of between 7-10 such as 7, 8, 9, or 10 nucleotides in length, to a person in need of treatment.

The invention further provides for a method for reducing the effective amount of a miRNA target (i.e. 'available' miRNA) in a cell or an organism, comprising administering a composition (such as the pharmaceutical composition) comprising a oligomer of between 6 7-10 such as 7, 8, 9, or 10 nucleotides in length, to the cell or the organism.

It should be recognised that "reducing the effective amount" of one or more microRNAs in a cell or organism, refers to the inhibition of the microRNA function in the call or organism. The cell is preferably a amammalain cell or a human cell which expresses the microRNA or microRNAs.

The invention further provides for a method for de-repression of a target mRNA of a miRNA in a cell or an organism, comprising a oligomer of 7-10 such as 7, 8, 9, or 10 nucleotides in length, or (or a composition comprising said oligonucleotide) to the cell or the organism.

As mentioned above, microRNAs are related to a number of diseases. Hence, a fourth aspect of the invention relates to the use of an oligonucleotide as defined herein for the manufacture of a medicament for the treatment of a disease associated with the expression of microRNAs selected from the group consisting of spinal muscular atrophy, Tourette's syndrome, hepatitis C, fragile X mental retardation, DiGeorge syndrome and cancer, such as in non limiting example, chronic lymphocytic leukemia, breast cancer, lung cancer and colon cancer, in particular cancer.

Methods of Synthesis

The invention further provides for a method for the synthesis of an oligomer targeted against a human microRNA, such as an oligomer described herein, said method comprising the steps of:

a. Optionally selecting a first nucleotide, counting from the 3' end, which is a nucleotide analogue, such as an LNA nucleotide.

b. Optionally selecting a second nucleotide, counting from the 3' end, which is a nucleotide analogue, such as an LNA nucleotide.

c. Selecting a region of the oligomer which corresponds to the miRNA seed region, wherein said region is as defined herein.

d. Selecting a seventh and optionally an eight nucleotideas defined herein.

e. Optionally selecting one or two further 5' terminal of the oligomer is as defined herein;

wherein the synthesis is performed by sequential synthesis of the regions defined in steps a-e, wherein said synthesis may be performed in either the 3'-5' (a to f) or 5'-3' (e to a) direction, and wherein said oligomer is complementary to a sequence of the miRNA target.

The invention further provides for a method for the preparation of an oligomer (such as an oligomer according to the invention), said method comprising the steps of a) comparing the sequences of two or more miRNA sequences to identify two or more miRNA sequences which comprise a common contiguous nucleotide sequence of at least 7 nucleotides in length, such as 7, 8, 9 or 10 nucleotides in length (i.e. a sequence found in both non-identical miRNAs), b) preparing an oligomer sequence which consists or comprises of a contiguous nucleotide sequence with is complementary to said common contiguous nucleotide sequence, wherein said oligomer is, as according to the oligomer of the invention. In a preferred example, the common contiguous nucleotide sequence consists or comprises of the seed region of each of said two or more miRNA sequences (which comprise a common contiguous nucleotide sequence of at least 6 nucleotides in length). In one embodiment, the seed regions of the two or more miRNAs are identical. Suitably the oligomer consists or comprises a seedmer sequence of 7 or 8 nucleotides in length which comprises of a sequence which is complementary to said two or more miRNAs. This method may be used in conjunction with step c of the above method.

The method for the synthesis of the oligomer according to the invention may be performed using standard solid phase oligonucleotide systhesis.

In one embodiment, the method for the synthesis of a oligomer targeted against a human microRNA, is performed in the 3' to 5' direction a-e. A further aspect of the invention is a method to reduce the levels of target microRNA by contacting the target microRNA to an oligonucleotide as defined herein, wherein the oligonucleotide (i) is complementary to the target microRNA sequence (ii) does not contain a nucleotide at the 3' end that corresponds to the first 5' end nucleotide of the target microRNA.

Duplex Stability and $T_m$

In one embodiment, the oligomer of the invention is capable of forming a duplex with a complementary single stranded RNA nucleic acid molecule (typically of about the same length of said single stranded oligonucleotide) with phosphodiester internucleoside linkages, wherein the duplex has a $T_m$ of between 30° C. and 70° C. or 80° C., such as between 30° C. and 60° C. of 70° C., or between 30° C. and 50° C. or 60° C. In one embodiment the $T_m$ is at least 40° C. $T_m$ may be determined by determining the $T_m$ of the oligomer and a complementary RNA target in the following buffer conditions: 100 mM NaCl, 0.1 mM EDTA, 10 mM Na-phosphate, pH 7.0 (see examples for a detailed protocol). A high affinity analogue may be defined as an analogue which, when used in the oligomer of the invention, results in an increase in the $T_m$ of the oligomer as compared to an identical oligomer which has contains only DNA bases.

Conjugates

In one embodiment, said oligomer is conjugated with one or more non-nucleotide (or poly-nucleotide) compounds.

In the context the term "conjugate" is intended to indicate a heterogenous molecule formed by the covalent attachment ("conjugation") of the oligomer as described herein to one or more non-nucleotide, or non-polynucleotide moieties. Examples of non-nucleotide or non-polynucleotide moieties include macromolecular agents such as proteins, fatty acid chains, sugar residues, glycoproteins, polymers, or combinations thereof. Typically proteins may be antibodies for a target protein. Typical polymers may be polyethylene glycol.

Therefore, in various embodiments, the oligomer of the invention may comprise both a polynucleotide region which typically consists of a contiguous sequence of nucleotides, and a further non-nucleotide region. When referring to the oligomer of the invention consisting of a contiguous nucleotide sequence, the compound may comprise non-nucleotide components, such as a conjugate component.

In various embodiments of the invention the oligomeric compound is linked to ligands/conjugates, which may be used, e.g. to increase the cellular uptake of oligomeric compounds. WO2007/031091 provides suitable ligands and conjugates, which are hereby incorporated by reference.

The invention also provides for a conjugate comprising the compound according to the invention as herein described, and at least one non-nucleotide or non-polynucleotide moiety covalently attached to said compound. Therefore, in various embodiments where the compound of the invention consists of a specified nucleic acid or nucleotide sequence, as herein disclosed, the compound may also comprise at least one non-nucleotide or non-polynucleotide moiety (e.g. not comprising one or more nucleotides or nucleotide analogues) covalently attached to said compound.

Conjugation (to a conjugate moiety) may enhance the activity, cellular distribution or cellular uptake of the oligomer of the invention. Such moieties include, but are not limited to, antibodies, polypeptides, lipid moieties such as a cholesterol moiety, cholic acid, a thioether, e.g. Hexyl-s-tritylthiol, a thiocholesterol, an aliphatic chain, e.g., dodecandiol or undecyl residues, a phospholipids, e.g., di-hexadecyl-rac-glycerol or triethylammonium 1,2-di-o-hexadecyl-rac-glycero-3-h-phosphonate, a polyamine or a polyethylene glycol chain, an adamantane acetic acid, a palmityl moiety, an octadecylamine or hexylamino-carbonyl-oxycholesterol moiety.

The oligomers of the invention may also be conjugated to active drug substances, for example, aspirin, ibuprofen, a sulfa drug, an antidiabetic, an antibacterial or an antibiotic.

In certain embodiments the conjugated moiety is a sterol, such as cholesterol.

In various embodiments, the conjugated moiety comprises or consists of a positively charged polymer, such as a positively charged peptides of, for example between 1-50, such as 2-20 such as 3-10 amino acid residues in length, and/or polyalkylene oxide such as polyethylglycol(PEG) or polypropylene glycol—see WO 2008/034123, hereby incorporated by reference. Suitably the positively charged polymer, such as a polyalkylene oxide may be attached to the oligomer of the invention via a linker such as the releasable inker described in WO 2008/034123.

By way of example, the following conjugate moieties may be used in the conjugates of the invention:

In some embodiments, activated oligomers of the invention are synthesized by incorporating during the synthesis one or more monomers that is covalently attached to a functional moiety. In other embodiments, activated oligomers of the invention are synthesized with monomers that have not been functionalized, and the oligomer is functionalized upon completion of synthesis. In some embodiments, the oligomers are functionalized with a hindered ester containing an aminoalkyl linker, wherein the alkyl portion has the formula $(CH_2)_w$, wherein w is an integer ranging from 1 to 10, preferably about 6, wherein the alkyl portion of the alkylamino group can be straight chain or branched chain, and wherein the functional group is attached to the oligomer via an ester group (—O—C(O)—$(CH_2)_w$NH).

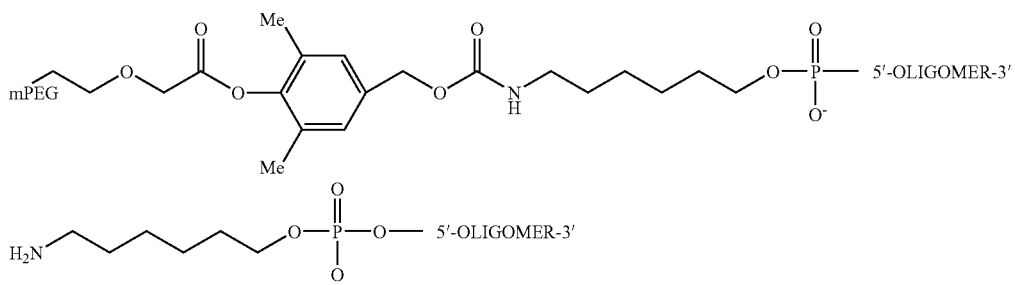

Activated Oligomers

The term "activated oligomer," as used herein, refers to an oligomer of the invention that is covalently linked (i.e., functionalized) to at least one functional moiety that permits covalent linkage of the oligomer to one or more conjugated moieties, i.e., moieties that are not themselves nucleic acids or monomers, to form the conjugates herein described. Typically, a functional moiety will comprise a chemical group that is capable of covalently bonding to the oligomer via, e.g., a 3'-hydroxyl group or the exocyclic $NH_2$ group of the adenine base, a spacer that is preferably hydrophilic and a terminal group that is capable of binding to a conjugated moiety (e.g., an amino, sulfhydryl or hydroxyl group). In some embodiments, this terminal group is not protected, e.g., is an $NH_2$ group. In other embodiments, the terminal group is protected, for example, by any suitable protecting group such as those described in "Protective Groups in Organic Synthesis" by Theodora W Greene and Peter G M Wuts, 3rd edition (John Wiley & Sons, 1999). Examples of suitable hydroxyl protecting groups include esters such as acetate ester, aralkyl groups such as benzyl, diphenylmethyl, or triphenylmethyl, and tetrahydropyranyl. Examples of suitable amino protecting groups include benzyl, alpha-methylbenzyl, diphenylmethyl, triphenylmethyl, benzyloxycarbonyl, tert-butoxycarbonyl, and acyl groups such as trichloroacetyl or trifluoroacetyl. In some embodiments, the functional moiety is self-cleaving. In other embodiments, the functional moiety is biodegradable. See e.g., U.S. Pat. No. 7,087,229, which is incorporated by reference herein in its entirety.

In some embodiments, oligomers of the invention are functionalized at the 5' end in order to allow covalent attachment of the conjugated moiety to the 5' end of the oligomer. In other embodiments, oligomers of the invention can be functionalized at the 3' end. In still other embodiments, oligomers of the invention can be functionalized along the backbone or on the heterocyclic base moiety. In yet other embodiments, oligomers of the invention can be functionalized at more than one position independently selected from the 5' end, the 3' end, the backbone and the base.

In other embodiments, the oligomers are functionalized with a hindered ester containing a $(CH_2)_w$-sulfhydryl (SH) linker, wherein w is an integer ranging from 1 to 10, preferably about 6, wherein the alkyl portion of the alkylamino group can be straight chain or branched chain, and wherein the functional group attached to the oligomer via an ester group (—O—C(O)—$(CH_2)_w$SH).

In some embodiments, sulfhydryl-activated oligonucleotides are conjugated with polymer moieties such as polyethylene glycol or peptides (via formation of a disulfide bond).

Activated oligomers containing hindered esters as described above can be synthesized by any method known in the art, and in particular by methods disclosed in PCT Publication No. WO 2008/034122 and the examples therein, which is incorporated herein by reference in its entirety.

In still other embodiments, the oligomers of the invention are functionalized by introducing sulfhydryl, amino or hydroxyl groups into the oligomer by means of a functionalizing reagent substantially as described in U.S. Pat. Nos. 4,962,029 and 4,914,210, i.e., a substantially linear reagent having a phosphoramidite at one end linked through a hydrophilic spacer chain to the opposing end which comprises a protected or unprotected sulfhydryl, amino or hydroxyl group. Such reagents primarily react with hydroxyl groups of the oligomer. In some embodiments, such activated oligomers have a functionalizing reagent coupled to a 5'-hydroxyl group of the oligomer. In other embodiments, the activated oligomers have a functionalizing reagent coupled to a 3'-hydroxyl group. In still other embodiments, the activated oligomers of the invention have a functionalizing reagent coupled to a hydroxyl group on the backbone of the oligomer. In yet further embodiments, the oligomer of the invention is functionalized with more than one of the functionalizing reagents as described in U.S. Pat. Nos. 4,962,029 and 4,914,210, incorporated herein by reference in their entirety. Methods of synthesizing such functionalizing reagents and incorporating them into monomers or oligomers are disclosed in U.S. Pat. Nos. 4,962,029 and 4,914,210.

In some embodiments, the 5'-terminus of a solid-phase bound oligomer is functionalized with a dienyl phosphoramidite derivative, followed by conjugation of the deprotected oligomer with, e.g., an amino acid or peptide via a Diels-Alder cycloaddition reaction.

In various embodiments, the incorporation of monomers containing 2'-sugar modifications, such as a 2'-carbamate substituted sugar or a 2'-(O-pentyl-N-phthalimido)-deoxyribose sugar into the oligomer facilitates covalent attachment of conjugated moieties to the sugars of the oligomer. In other embodiments, an oligomer with an amino-containing linker at the 2'-position of one or more monomers is prepared using a reagent such as, for example, 5'-dimethoxytrityl-2'-O-(e-phthalimidylaminopentyl)-2'-deoxyadenosine-3'-N,N-diisopropyl-cyanoethoxy phosphoramidite. See, e.g., Manoharan, et al., Tetrahedron Letters, 1991, 34, 7171.

In still further embodiments, the oligomers of the invention may have amine-containing functional moieties on the nucleotide, including on the N6 purine amino groups, on the exocyclic N2 of guanine, or on the N4 or 5 positions of cytosine. In various embodiments, such functionalization may be achieved by using a commercial reagent that is already functionalized in the oligomer synthesis.

Some functional moieties are commercially available, for example, heterobifunctional and homobifunctional linking moieties are available from the Pierce Co. (Rockford, Ill.). Other commercially available linking groups are 5'-Amino-Modifier C6 and 3'-Amino-Modifier reagents, both available from Glen Research Corporation (Sterling, Va.). 5'-Amino-Modifier C6 is also available from ABI (Applied Biosystems Inc., Foster City, Calif.) as Aminolink-2, and 3'-Amino-Modifier is also available from Clontech Laboratories Inc. (Palo Alto, Calif.).

Therapy and Pharmaceutical Compositions—Formulation and Administration

As explained initially, the oligonucleotides of the invention will constitute suitable drugs with improved properties. The design of a potent and safe drug requires the fine-tuning of various parameters such as affinity/specificity, stability in biological fluids, cellular uptake, mode of action, pharmacokinetic properties and toxicity.

Accordingly, in a further aspect the present invention relates to a pharmaceutical composition comprising an oligonucleotide according to the invention and a pharmaceutically acceptable diluent, carrier or adjuvant. Preferably said carrier is saline or buffered saline.

In a still further aspect the present invention relates to an oligonucleotide according to the present invention for use as a medicament.

As will be understood, dosing is dependent on severity and responsiveness of the disease state to be treated, and the course of treatment lasting from several days to several months, or until a cure is effected or a diminution of the disease state is achieved. Optimal dosing schedules can be calculated from measurements of drug accumulation in the body of the patient. Optimum dosages may vary depending on the relative potency of individual oligonucleotides. Generally it can be estimated based on EC50s found to be effective in in vitro and in vivo animal models. In general, dosage is from 0.01 µg to 1 g per kg of body weight, and may be given once or more daily, weekly, monthly or yearly, or even once every 2 to 10 years or by continuous infusion for hours up to several months. The repetition rates for dosing can be estimated based on measured residence times and concentrations of the drug in bodily fluids or tissues. Following successful treatment, it may be desirable to have the patient undergo maintenance therapy to prevent the recurrence of the disease state.

As indicated above, the invention also relates to a pharmaceutical composition, which comprises at least one oligonucleotide of the invention as an active ingredient. It should be understood that the pharmaceutical composition according to the invention optionally comprises a pharmaceutical carrier, and that the pharmaceutical composition optionally comprises further compounds, such as chemotherapeutic compounds, anti-inflammatory compounds, antiviral compounds and/or immuno-modulating compounds.

The oligonucleotides of the invention can be used "as is" or in form of a variety of pharmaceutically acceptable salts. As used herein, the term "pharmaceutically acceptable salts" refers to salts that retain the desired biological activity of the herein-identified oligonucleotides and exhibit minimal undesired toxicological effects. Non-limiting examples of such salts can be formed with organic amino acid and base addition salts formed with metal cations such as zinc, calcium, bismuth, barium, magnesium, aluminum, copper, cobalt, nickel, cadmium, sodium, potassium, and the like, or with a cation formed from ammonia, N,N-dibenzylethylenediamine, D-glucosamine, tetraethylammonium, or ethylenediamine.

In one embodiment of the invention, the oligonucleotide may be in the form of a pro-drug. Oligonucleotides are by virtue negatively charged ions. Due to the lipophilic nature of cell membranes the cellular uptake of oligonucleotides are reduced compared to neutral or lipophilic equivalents. This polarity "hindrance" can be avoided by using the pro-drug approach (see e.g. Crooke, R. M. (1998) in Crooke, S. T. Antisense research and Application. Springer-Verlag, Berlin, Germany, vol. 131, pp. 103-140).

Pharmaceutically acceptable binding agents and adjuvants may comprise part of the formulated drug.

Examples of delivery methods for delivery of the therapeutic agents described herein, as well as details of pharmaceutical formulations, salts, may are well described elsewhere for example in U.S. provisional application 60/838,710 and 60/788,995, which are hereby incorporated by reference, and Danish applications, PA 2006 00615 which is also hereby incorporated by reference.

Pharmaceutical compositions of the present invention include, but are not limited to, solutions, emulsions, and liposome-containing formulations. These compositions may be generated from a variety of components that include, but are not limited to, preformed liquids, self-emulsifying solids and self-emulsifying semisolids. Delivery of drug to tumour tissue may be enhanced by carrier-mediated delivery including, but not limited to, cationic liposomes, cyclodextrins, porphyrin derivatives, branched chain dendrimers, polyethylenimine polymers, nanoparticles and microspheres (Dass C R. J Pharm Pharmacol 2002; 54(1):3-27). The pharmaceutical formulations of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general the formulations are prepared by uniformly and intimately bringing into association the active ingredients with liquid carriers or finely divided solid carriers or both, and then, if necessary, shaping the product. The compositions of the present invention may be formulated into any of many possible dosage forms such as, but not limited to, tablets, capsules, gel capsules, liquid syrups, soft gels and suppositories. The compositions of the present invention may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers. The compounds of the invention may also be conjugated to active drug substances, for example, aspirin, ibuprofen, a sulfa drug, an antidiabetic, an antibacterial or an antibiotic.

In another embodiment, compositions of the invention may contain one or more oligonucleotide compounds, targeted to a first microRNA and one or more additional oligonucleotide compounds targeted to a second microRNA target. Two or more combined compounds may be used together or sequentially.

The compounds disclosed herein are useful for a number of therapeutic applications as indicated above. In general, therapeutic methods of the invention include administration of a therapeutically effective amount of an oligonucleotide to a mammal, particularly a human. In a certain embodiment, the present invention provides pharmaceutical compositions containing (a) one or more compounds of the invention, and (b) one or more chemotherapeutic agents. When used with the compounds of the invention, such chemotherapeutic agents may be used individually, sequentially, or in combination with one or more other such chemotherapeutic agents or in combination with radiotherapy. All chemotherapeutic agents known to a person skilled in the art are here incorporated as combination treatments with compound according to the invention. Other active agents, such as anti-inflammatory drugs, including but not limited to nonsteroidal anti-inflammatory drugs and corticosteroids, antiviral drugs, and immuno-modulating drugs may also be combined in compositions of the invention. Two or more combined compounds may be used together or sequentially.

Examples of therapeutic indications which may be treated by the pharmaceutical compositions of the invention:

| microRNA | Possible medical indications |
|---|---|
| miR-1 | Cardiac arythmia |
| miR-21 | Glioblastoma, breast cancer, hepatocellular carcinoma, colorectal cancer, sensitization of gliomas to cytotoxic drugs, cardiac hypertrophy |
| miR-21, miR-200b and miR-141 | Response to chemotherapy and regulation of cholangiocarcinoma growth |
| miR-122 | hypercholesterolemia, hepatitis C infection, hemochromatosis |
| miR-19b | lymphoma and other tumour types |
| miR-26a | Osteoblast differentiation of human stem cells |
| miR-155 | lymphoma, pancreatic tumor development, breast and lung cancer |
| miR-203 | Psoriasis |
| miR-375 | diabetes, metabolic disorders, glucose-induced insulin secretion from pancreatic endocrine cells |
| miR-181 | myoblast differentiation, auto immune disorders |
| miR-10b | Breast cancer cell invasion and metastasis |
| miR-125b-1 | Breast, lung, ovarian and cervical cancer |
| miR-221 and 222 | Prostate carcinoma, human thyroid papillary car, human hepatocellular carcinoma |
| miRNA-372 and -373 | testicular germ cell tumors. |
| miR-142 | B-cell leukemia |
| miR-17-19b cluster | B-cell lymphomas, lung cancer, hepatocellular carcinoma |

Tumor suppressor gene tropomysin 1 (TPM1) mRNA has been indicated as a target of miR-21. Myotrophin (mtpn) mRNA has been indicated as a target of miR 375.

In an even further aspect, the present invention relates to the use of an oligonucleotide according to the invention for the manufacture of a medicament for the treatment of a disease selected from the group consisting of: atherosclerosis, hypercholesterolemia and hyperlipidemia; cancer, glioblastoma, breast cancer, lymphoma, lung cancer; diabetes, metabolic disorders; myoblast differentiation; immune disorders.

The invention further refers to oligonucleotides according to the invention for the use in the treatment of from a disease selected from the group consisting of: atherosclerosis, hypercholesterolemia and hyperlipidemia; cancer, glioblastoma, breast cancer, lymphoma, lung cancer; diabetes, metabolic disorders; myoblast differentiation; immune disorders.

The invention provides for a method of treating a subject suffering from a disease or condition selected from the group consisting of: atherosclerosis, hypercholesterolemia and hyperlipidemia; cancer, glioblastoma, breast cancer, lymphoma, lung cancer; diabetes, metabolic disorders; myoblast differentiation; immune disorders, the method comprising the step of administering an oligonucleotide or pharmaceutical composition of the invention to the subject in need thereof.

The invention further provides for a kit comprising a pharmaceutical composition according to the invention, and a second independent active ingredient that is an inhibitor of the VLDL assembly pathway, such as an ApoB inhibitor, or an MTP inhibitor.

Cancer

In an even further aspect, the present invention relates to the use of an oligonucleotide according to the invention for the manufacture of a medicament for the treatment of cancer. In another aspect, the present invention concerns a method for treatment of, or prophylaxis against, cancer, said method comprising administering an oligonucleotide of the invention or a pharmaceutical composition of the invention to a patient in need thereof.

Such cancers may include lymphoreticular neoplasia, lymphoblastic leukemia, brain tumors, gastric tumors, plasmacytomas, multiple myeloma, leukemia, connective tissue tumors, lymphomas, and solid tumors.

In the use of a compound of the invention for the manufacture of a medicament for the treatment of cancer, said cancer may suitably be in the form of a solid tumor. Analogously, in the method for treating cancer disclosed herein said cancer may suitably be in the form of a solid tumor.

Furthermore, said cancer is also suitably a carcinoma. The carcinoma is typically selected from the group consisting of malignant melanoma, basal cell carcinoma, ovarian carcinoma, breast carcinoma, non-small cell lung cancer, renal cell carcinoma, bladder carcinoma, recurrent superficial bladder cancer, stomach carcinoma, prostatic carcinoma, pancreatic carcinoma, lung carcinoma, cervical carcinoma, cervical dysplasia, laryngeal papillomatosis, colon carcinoma, colorectal carcinoma and carcinoid tumors. More typically, said carcinoma is selected from the group consisting of malignant melanoma, non-small cell lung cancer, breast carcinoma, colon carcinoma and renal cell carcinoma. The malignant melanoma is typically selected from the group consisting of superficial spreading melanoma, nodular melanoma, lentigo maligna melanoma, acral melagnoma, amelanotic melanoma and desmoplastic melanoma.

Alternatively, the cancer may suitably be a sarcoma. The sarcoma is typically in the form selected from the group consisting of osteosarcoma, Ewing's sarcoma, chondrosarcoma, malignant fibrous histiocytoma, fibrosarcoma and Kaposi's sarcoma.

Alternatively, the cancer may suitably be a glioma.

A further embodiment is directed to the use of an oligonucleotide according to the invention for the manufacture of a medicament for the treatment of cancer, wherein said medicament further comprises a chemotherapeutic agent selected from the group consisting of adrenocorticosteroids, such as prednisone, dexamethasone or decadron; altretamine (hexylen, hexamethylmelamine (HMM)); amifostine (ethyol); aminoglutethimide (cytadren); amsacrine (M-AMSA); anastrozole (arimidex); androgens, such as testosterone; asparaginase (elspar); *bacillus* calmette-gurin; bicalutamide (casodex); bleomycin (blenoxane); busulfan (myleran); carboplatin (paraplatin); carmustine (BCNU, BiCNU); chlorambucil (leukeran); chlorodeoxyadenosine (2-CDA, cladribine, leustatin); cisplatin (platinol); cytosine arabinoside (cytarabine); dacarbazine (DTIC); dactinomycin (actinomycin-D, cosmegen); daunorubicin (cerubidine); docetaxel (taxotere); doxorubicin (adriomycin); epirubicin; estramustine (emcyt); estrogens, such as diethylstilbestrol (DES); etopside (VP-16, VePesid, etopophos); fludarabine (fludara); flutamide (eulexin); 5-FUDR (floxuridine); 5-fluorouracil (5-FU); gemcitabine (gemzar); goserelin (zodalex); herceptin (trastuzumab); hydroxyurea (hydrea); idarubicin (idamycin); ifosfamide; IL-2 (proleukin, aldesleukin); interferon alpha (intron A, roferon A); irinotecan (camptosar); leuprolide (lupron); levamisole (ergamisole); lomustine (CCNU); mechlorathamine (mustargen, nitrogen mustard); melphalan (alkeran); mercaptopurine (purinethol, 6-MP); methotrexate (mexate); mitomycin-C (mutamucin); mitoxantrone (novantrone); octreotide (sandostatin); pentostatin (2-deoxycoformycin, nipent); plicamycin (mithramycin, mithracin); prorocarbazine (matulane); streptozocin; tamoxifin (nolvadex); taxol (paclitaxel); teniposide (vumon, VM-26); thiotepa; topotecan (hycamtin); tretinoin (vesanoid, all-trans retinoic acid); vinblastine (valban); vincristine (oncovin) and vinorelbine (navelbine). Suitably, the further chemotherapeutic agent is selected from taxanes such as Taxol, Paclitaxel or Docetaxel.

Similarly, the invention is further directed to the use of an oligonucleotide according to the invention for the manufacture of a medicament for the treatment of cancer, wherein said treatment further comprises the administration of a further chemotherapeutic agent selected from the group consisting of adrenocorticosteroids, such as prednisone, dexamethasone or decadron; altretamine (hexylen, hexamethylmelamine (HMM)); amifostine (ethyol); aminoglutethimide (cytadren); amsacrine (M-AMSA); anastrozole (arimidex); androgens, such as testosterone; asparaginase (elspar); *bacillus* calmette-gurin; bicalutamide (casodex); bleomycin (blenoxane); busulfan (myleran); carboplatin (paraplatin); carmustine (BCNU, BiCNU); chlorambucil (leukeran); chlorodeoxyadenosine (2-CDA, cladribine, leustatin); cisplatin (platinol); cytosine arabinoside (cytarabine); dacarbazine (DTIC); dactinomycin (actinomycin-D, cosmegen); daunorubicin (cerubidine); docetaxel (taxotere); doxorubicin (adriomycin); epirubicin; estramustine (emcyt); estrogens, such as diethylstilbestrol (DES); etopside (VP-16, VePesid, etopophos); fludarabine (fludara); flutamide (eulexin); 5-FUDR (floxuridine); 5-fluorouracil (5-FU); gemcitabine (gemzar); goserelin (zodalex); herceptin (trastuzumab); hydroxyurea (hydrea); idarubicin (idamycin); ifosfamide; IL-2 (proleukin, aldesleukin); interferon alpha (intron A, roferon A); irinotecan (camptosar); leuprolide (lupron); levamisole (ergamisole); lomustine (CCNU); mechlorathamine (mustargen, nitrogen mustard); melphalan (alkeran); mercaptopurine (purinethol, 6-MP); methotrexate (mexate); mitomycin-C (mutamucin); mitoxantrone (novantrone); octreotide (sandostatin); pentostatin (2-deoxycoformycin, nipent); plicamycin (mithramycin, mithracin); prorocarbazine (matulane); streptozocin; tamoxifin (nolvadex); taxol (paclitaxel); teniposide (vumon, VM-26); thiotepa; topotecan (hycamtin); tretinoin (vesanoid, all-trans retinoic acid); vinblastine (valban); vincristine (oncovin) and vinorelbine (navelbine). Suitably, said treatment further comprises the administration of a further chemotherapeutic agent selected from taxanes, such as Taxol, Paclitaxel or Docetaxel.

Alternatively stated, the invention is furthermore directed to a method for treating cancer, said method comprising administering an oligonucleotide of the invention or a pharmaceutical composition according to the invention to a patient in need thereof and further comprising the administration of a further chemotherapeutic agent. Said further administration may be such that the further chemotherapeutic agent is conjugated to the compound of the invention, is present in the pharmaceutical composition, or is administered in a separate formulation.

Infectious Diseases

It is contemplated that the compounds of the invention may be broadly applicable to a broad range of infectious diseases, such as diphtheria, tetanus, pertussis, polio, hepatitis B, hepatitis C, *hemophilus influenza*, measles, mumps, and rubella.

Hsa-miR 122 (SEQ ID NO: 150) is indicated in hepatitis C infection and as such oligonucleotides according to the invention which target miR-122 may be used to treat Hepatitus C infection.

Accordingly, in yet another aspect the present invention relates the use of an oligonucleotide according to the invention for the manufacture of a medicament for the treatment of an infectious disease, as well as to a method for treating an infectious disease, said method comprising administering an oligonucleotide according to the invention or a pharmaceutical composition according to the invention to a patient in need thereof.

In a preferred embodiment, the invention provides for a combination treatment providing an anti miR-122 oligomer in combination with an inhibitor of VLDL assembly, such as an inhibitor of apoB, or of MTP.

Inflammatory Diseases

The inflammatory response is an essential mechanism of defense of the organism against the attack of infectious agents, and it is also implicated in the pathogenesis of many acute and chronic diseases, including autoimmune disorders. In spite of being needed to fight pathogens, the effects of an inflammatory burst can be devastating. It is therefore often necessary to restrict the symptomatology of inflammation with the use of anti-inflammatory drugs. Inflammation is a complex process normally triggered by tissue injury that includes activation of a large array of enzymes, the increase in vascular permeability and extravasation of blood fluids, cell migration and release of chemical mediators, all aimed to both destroy and repair the injured tissue.

In yet another aspect, the present invention relates to the use of an oligonucleotide according to the invention for the manufacture of a medicament for the treatment of an inflammatory disease, as well as to a method for treating an inflammatory disease, said method comprising administering an oligonucleotide according to the invention or a pharmaceutical composition according to the invention to a patient in need thereof.

In one preferred embodiment of the invention, the inflammatory disease is a rheumatic disease and/or a connective tissue diseases, such as rheumatoid arthritis, systemic lupus erythematous (SLE) or Lupus, scleroderma, polymyositis, inflammatory bowel disease, dermatomyositis, ulcerative colitis, Crohn's disease, vasculitis, psoriatic arthritis, exfoliative psoriatic dermatitis, pemphigus vulgaris and Sjorgren's syndrome, in particular inflammatory bowel disease and Crohn's disease.

Alternatively, the inflammatory disease may be a non-rheumatic inflammation, like bursitis, synovitis, capsulitis, tendinitis and/or other inflammatory lesions of traumatic and/or sportive origin.

Metabolic Diseases

A metabolic disease is a disorder caused by the accumulation of chemicals produced naturally in the body. These diseases are usually serious, some even life threatening. Others may slow physical development or cause mental retardation. Most infants with these disorders, at first, show no obvious signs of disease. Proper screening at birth can often discover these problems. With early diagnosis and treatment, metabolic diseases can often be managed effectively.

In yet another aspect, the present invention relates to the use of an oligonucleotide according to the invention or a conjugate thereof for the manufacture of a medicament for the treatment of a metabolic disease, as well as to a method for treating a metabolic disease, said method comprising administering an oligonucleotide according to the invention or a conjugate thereof, or a pharmaceutical composition according to the invention to a patient in need thereof.

In one preferred embodiment of the invention, the metabolic disease is selected from the group consisting of Amyloidosis, Biotimidase, OMIM (Online Mendelian Inheritance in Man), Crigler Najjar Syndrome, Diabetes, Fabry Support & Information Group, Fatty acid Oxidation Disorders, Galactosemia, Glucose-6-Phosphate Dehydrogenase (G6PD) deficiency, Glutaric aciduria, International Organization of Glutaric Acidemia, Glutaric Acidemia Type I, Glutaric Acidemia, Type II, Glutaric Acidemia Type I, Glutaric Acidemia Type-II, F-HYPDRR-Familial Hypophosphatemia, Vitamin D Resistant Rickets, Krabbe Disease, Long chain 3 hydroxyacyl CoA dehydrogenase deficiency (LCHAD), Mannosidosis Group, Maple Syrup Urine Disease, Mitochondrial disorders, Mucopolysaccharidosis Syndromes: Niemann Pick, Organic acidemias, PKU, Pompe disease, Porphyria, Metabolic Syndrome, Hyperlipidemia and inherited lipid disorders, Trimethylaminuria: the fish malodor syndrome, and Urea cycle disorders.

Liver Disorders

In yet another aspect, the present invention relates to the use of an oligonucleotide according to the invention or a conjugate thereof for the manufacture of a medicament for the treatment of a liver disorder, as well as to a method for treating a liver disorder, said method comprising administering an oligonucleotide according to the invention or a conjugate thereof, or a pharmaceutical composition according to the invention to a patient in need thereof.

In one preferred embodiment of the invention, the liver disorder is selected from the group consisting of Biliary Atresia, Alagille Syndrome, Alpha-1 Antitrypsin, Tyrosinemia, Neonatal Hepatitis, and Wilson Disease.

Other Uses

The oligonucleotides of the present invention can be utilized for as research reagents for diagnostics, therapeutics and prophylaxis. In research, the oligonucleotide may be used to specifically inhibit the synthesis of target genes in cells and experimental animals thereby facilitating functional analysis of the target or an appraisal of its usefulness as a target for therapeutic intervention. In diagnostics the oligonucleotides may be used to detect and quantitate target expression in cell and tissues by Northern blotting, in-situ hybridisation or similar techniques. For therapeutics, an animal or a human, suspected of having a disease or disorder, which can be treated by modulating the expression of target is treated by administering the oligonucleotide compounds in accordance with this invention. Further provided are methods of treating an animal particular mouse and rat and treating a human, suspected of having or being prone to a disease or condition, associated with expression of target by administering a therapeutically or prophylactically effective amount of one or more of the oligonucleotide compounds or compositions of the invention.

Therapeutic Use of Oligonucleotides Targeting miR-122a

We have demonstrated that a LNA-antimiR, targeting miR-122a reduces plasma cholesterol levels. Therefore, another aspect of the invention is use of the above described oligonucleotides targeting miR-122a as medicine.

Still another aspect of the invention is use of the above described oligonucleotides targeting miR-122a for the preparation of a medicament for treatment of increased plasma cholesterol levels (or hypercholesterolemia and related disorders). The skilled man will appreciate that increased plasma cholesterol levels is undesirable as it increases the risk of various conditions, e.g. atherosclerosis.

Still another aspect of the invention is use of the above described oligonucleotides targeting miR-122a for upregulating the mRNA levels of Nrdg3, Aldo A, Bckdk or CD320.

EMBODIMENTS

The following embodiments of the present invention may be used in combination with the other embodiments described herein.

1. A pharmaceutical composition comprising an oligomer of between 6-12 nucleotides in length, wherein said oligomer comprises a contiguous nucleotide sequence of a total of between 6-12 nucleotides, such as 6, 7, 8, 9, 10, 11 or 12 nucleotide units, wherein at least 50% of the nucleobase units of the oligomer are high affinity nucleotide analogue units, and a pharmaceutically acceptable diluent, carrier, salt or adjuvant.

2. The pharmaceutical composition according to embodiment 1, wherein the contiguous nucleotide sequence is complementary to a corresponding region of a mammalian, human or viral microRNA (miRNA) sequence.

3. The pharmaceutical composition according to embodiment 2, wherein the contiguous nucleotide sequence is complementary to a corresponding region of a miRNA sequence selected from the group of miRNAs listed in any one of tables 3, 4 or 5.

4. The pharmaceutical composition according to embodiment 2 or 3, wherein the contiguous nucleotide sequence consists of or comprises a sequence which is complementary to the seed sequence of said microRNA.

5. The pharmaceutical composition according to any one of embodiments 2-4, wherein the contiguous nucleotide sequence consists of or comprises a sequence selected from any one of the sequences listed in table 3 or 4.

6. The pharmaceutical composition according to embodiment 4 or 5, wherein the 3' nucleobase of the seedmer forms the 3' most nucleobase of the contiguous nucleotide sequence, wherein the contiguous nucleotide sequence may, optionally, comprise one or two further 5' nucleobases.

7. The pharmaceutical composition according to any one of embodiments 1-6, wherein said contiguous nucleotide sequence does not comprise a nucleotide which corresponds to the first nucleotide present in the micro RNA sequence counted from the 5' end.

8. The pharmaceutical composition according to any one of embodiments 1-7, wherein the contiguous nucleotide sequence is complementary to a corresponding nucleotide sequence present in a miRNA selected from those shown in table 3 or 4 or 5.

9. The pharmaceutical composition according to embodiment 8, wherein said miRNA is selected from the group consisting of miR-1, miR-10b, miR-17-3p, miR-18, miR-19a, miR-19b, miR-20, miR-21, miR-34a, miR-93, miR-106a, miR-106b, miR-122, miR-133, miR-134, miR-138, miR-155, miR-192, miR-194, miR-221, miR-222, and miR-375.

10. The pharmaceutical composition according to any one of embodiments 1-9, wherein at least 60%, 65%, 70%, 75%, 80%, 85%, 90%, 95% or all of the nucleobase units of the contiguous nucleotide sequence are nucleotide analogue units.

11. The pharmaceutical composition according to embodiment 10, wherein the nucleotide analogue units are selected from the group consisting of 2'-O_alkyl-RNA unit, 2'-OMe-RNA unit, 2'-amino-DNA unit, 2'-fluoro-DNA unit, LNA unit, PNA unit, HNA unit, INA unit, and a 2'MOE RNA unit.

12. The pharmaceutical composition according to embodiment 10 or 11, wherein at least 60%, 65%, 70%, 75%, 80%, 85%, 90%, 95% or all of the nucleobase units of the contiguous nucleotide sequence are Locked Nucleic Acid (LNA) nucleobase units.

13. The pharmaceutical composition according to embodiment 12, wherein all of the nucleobase units of the contiguous nucleotide sequence are LNA nucleobase units.

14. The pharmaceutical composition according to any one of embodiments 1-13, wherein the contiguous nucleotide sequence comprises or consists of 7, 8, 9 or 10, preferably contiguous, LNA nucleobase units.

15. The pharmaceutical composition according to any one of embodiments 1-14, wherein the oligomer consist of 7, 8, 9 or 10 contiguous nucleobase units and wherein at least 7 nucleobase units are nucleotide analogue units.

16. The pharmaceutical composition according to embodiment 15, wherein the nucleotide analogue units are Locked Nucleic Acid (LNA) nucleobase units.

17. The pharmaceutical composition according to embodiment 15, wherein the nucleotide analogue units in the molecule consists of a mixture of at least 50% LNA units and up to 50% other nucleotide analogue units.

18. The pharmaceutical composition according to any one of embodiments 1-17, wherein at least 75%, such as 80% or 85% or 90% or 95% or all of the internucleoside linkages present between the nucleobase units of the contiguous nucleotide sequence are phosphorothioate internucleoside linkages.

19. The pharmaceutical composition according to any one of embodiments 1-18, wherein said oligomer is conjugated with one or more non-nucleobase compounds.

20. The pharmaceutical composition according to any one of embodiments 1-19, wherein the contiguous nucleotide sequence is complementary to the corresponding sequence of at least two miRNA sequences such as 2, 3, 4, 5, 6, 7, 8, 9, or 10 miRNA sequences.

21. The pharmaceutical composition according to any one of embodiments 1-20, wherein the contiguous nucleotide sequence consists or comprises of a sequence which is complementary to the sequence of at least two miRNA seed region sequences such as 2, 3, 4, 5, 6, 7, 8, 9, or 10 miRNA seed region sequences.

22. The pharmaceutical composition according to any one of embodiments 20 or 21, wherein the contiguous nucleotide sequence is complementary to the corresponding region of both miR-221 and miR-222.

23. The pharmaceutical composition according to embodiment 22, wherein the contiguous nucleotide sequence consists or comprises of a sequence that is complementary to 5'GCUACAU3'.

24. The pharmaceutical composition according to any one of embodiments 1-23, wherein the oligomer is constituted as a prodrug.

25. The pharmaceutical composition according to any one of embodiments 1-24, wherein the contiguous nucleotide sequence is complementary to a corresponding region of has-miR-122.

26. The pharmaceutical composition according to embodiment 25, for use in the treatment of a medical disorder or disease selected from the group consisting of: hepatitis C virus infection and hypercholesterolemia and related disorders.

27. The pharmaceutical composition according to embodiment 25 or 26, wherein the composition further comprises a second independent active ingredient that is an inhibitor of the VLDL assembly pathway, such as an ApoB inhibitor, or an MTP inhibitor.

28. A kit comprising a pharmaceutical composition according to embodiment 25 or 26, and a second independent active ingredient that is an inhibitor of the VLDL assembly pathway, such as an ApoB inhibitor, or an MTP inhibitor.

29. A method for the treatment of a disease or medical disorder associated with the presence or overexpression of a microRNA, comprising the step of administering a the pharmaceutical composition) according to any one of embodiments 1-28 to a patient who is suffering from, or is likely to siffer from said disease or medical disorder.

30. An oligomer, as defined according to anyone of embodiments 1-25.

31. A conjugate comprising the oligomer according to embodiment 30, and at least one non-nucleobase compounds.

32. The use of an oligomer or a conjugate as defined in any one of embodiments 30-31, for the manufacture of a medicament for the treatment of a disease or medical disorder associated with the presence or over-expression of the microRNA.

33. A method for reducing the amount, or effective amount, of a miRNA in a cell, comprising administering an oligomer, a conjugate or a pharmaceutical composition, according to any one of the preceeding embodiments to the cell which is expressing said miRNA so as to reduce the amount, or effective amount of the miRNA in the cell.

34. A method for de-repression of a mRNA whose expression is repressed by a miRNA in a cell comprising administering an oligomer, a conjugate or a pharmaceutical composition, according to any one of the preceeding embodiments to the cell to the cell which expressed both said mRNA and said miRNA, in order to de-repress the expression of the mRNA.

References: Details of the reference are provided in the priority documents.

EXAMPLES

LNA Monomer and oligonucleotide synthesis were performed using the methodology referred to in Examples 1 and 2 of WO2007/112754. The stability of LNA oligonucletides in human or rat plasma is performed using the methodology referred to in Example 4 of WO2007/112754. The treatment of in vitro cells with LNA anti-miR antisense oligonucleotide (targeting miR-122) is performed using the methodology referred to in Example 6 of WO2007/112754. The analysis of Oligonucleotide Inhibition of miR expression by microRNA specific quantitative PCR in both an in vitro and in vivo model is performed using the methodology referred to in Example 7 of WO2007/112754. The assessment of LNA antimiR knockdown specificity using miRNA microarray expression profiling is performed using the methodology referred to in Example 8 of WO2007/112754. The detection of microRNAs by in situ hybridization is performed using the methodology referred to in Example 9 of WO2007/112754. The Isolation and analysis of mRNA expression (total RNA isolation and cDNA synthesis for mRNA analysis) in both an in vitro and in vivo model is performed using the methodology referred to in Example 10 of WO2007/112754. In vivo Experiments using Oligomers of the invention targeting microRNA-122. and subsequent analysis are performed using the methods disclosed in Examples 11-27 of WO2007/112754. The above mentioned examples of WO2007/112754 are hereby specifically incorporated by reference.

Example 1

Design of the LNA AntimiR Oligonucleotides and Melting Temperatures

TABLE 2

Oligomers used in the examples and figures. The Compound number is an identifier used throughout the examples and figures - the SEQ ID NO which is used in the sequence listing is also provided.

| Compound | SEQ ID NO | Compound Sequence | Comment |
|---|---|---|---|
| 3204 | 1 | TcAGtCTGaTaAgCT | |
| 3205 | 2 | GATAAGCT | |
| 3206 | 3 | TcAcAATtaGCAtTA | |
| 3207 | 4 | TAGCATTA | |
| 4 | 5 | CcAttGTcaCaCtCC | |
| 3208 | 6 | CACACTCC | |
| 3209 | 7 | TAAGCT | |
| 3210 | 8 | ATAAGCT | |
| 3211 | 9 | TGATAAGCT | |
| 3212 | 10 | CTGATAAGCT | |
| 3213 | 11 | GTCTGATAAGCT | |
| 2114 | 12 | CAGTCTGATAAGCT | |
| 3215 | 13 | TCTGATAA | |
| 3216 | 14 | ATCAGTCT | |
| 3217 | 15 | TCAACATC | |
| 3218 or 3230 | 16 | GG<u>T</u>AA<u>A</u>CT | Underline = mismatch |
| 3219 | 17 | <u>C</u>GTAA<u>T</u>GA | Underline = mismatch |
| 3220 | 18 | TCAgtctgataaGCTa | 5' fluorescent label (FAM) |

TABLE 2-continued

Oligomers used in the examples and figures. The Compound number is an identifier used throughout the examples and figures - the SEQ ID NO which is used in the sequence listing is also provided.

| Compound | SEQ ID NO | Compound Sequence | Comment |
|---|---|---|---|
| 3221 | 19 | AGCACTTT | |
| 3222 | 20 | ATTTGCAC | |
| 3223 | 21 | AgCagACaaTgTaGC | 5' fluorescent label (FAM) |
| 3224 | 22 | GtAgcCAgaTgTaGC | 5' fluorescent label (FAM) |
| 3225 | 23 | ATGTAGC | |
| 3226 | 24 | ACaAcCTacTaCcTC | |
| 3227 | 25 | ACTACCTC | |
| 3228 | 26 | CaCtgTCagCaCtTT | |
| 3229 | 27 | TgCatAGatTtGcAC | |
| 3231 | 28 | GTAGACT | |
| 3232 | 29 | TACCTC | |
| 3233 | 30 | CTACCTC | |
| 3234 | 31 | TNCTACCTC | N = universal base. |
| 3235 | 32 | TNCTACCTC | N = universal base. |
| 3236 | 33 | GCaAcCTacTaCcTC | |
| 3237 | 34 | ACaAcCTccTaCcTC | |
| 3238 | 35 | ACaAaCTacTaCcTC | |
| 3239 | 36 | CTACCTC | |
| 3240 | 37 | CTAACTC | |
| 3241 | 38 | TTAGCATTA | |
| 3242 | 39 | CGATTAGCATTA | |
| 3243 | 977 | CACGATTAGCATTA | |
| 3244 | 978 | GCATTA | |
| 3245 | 979 | AGCATTA | |
| 3246 | 980 | ATTAGCATTA | |

Capital and lower case letters denote LNA and DNA, respectively.
LNA cytosines are preferably methyl cytosine/5'methyl-cytosine*
All internucleoside linkages are preferably phosphorothioate*
All LNA may, for example, be beta-D-oxy LNA*
*Used in the specific examples.

Example 2

In Vitro Model: Cell Culture

The effect of LNA oligonucleotides on target nucleic acid expression (amount) can be tested in any of a variety of cell types provided that the target nucleic acid is present at measurable levels. Target can be expressed endogenously or by transient or stable transfection of a nucleic acid encoding said nucleic acid.

The expression level of target nucleic acid can be routinely determined using, for example, Northern blot analysis (including microRNA northern), Quantitative PCR (including microRNA qPCR), Ribonuclease protection assays. The following cell types are provided for illustrative purposes, but other cell types can be routinely used, provided that the target is expressed in the cell type chosen.

Cells were cultured in the appropriate medium as described below and maintained at 37° C. at 95-98% humidity and 5% $CO_2$. Cells were routinely passaged 2-3 times weekly.

15PC3: The human prostate cancer cell line 15PC3 was kindly donated by Dr. F. Baas, Neurozintuigen Laboratory, AMC, The Netherlands and was cultured in DMEM (Sigma)+10% fetal bovine serum (FBS)+Glutamax I+gentamicin.

PC3: The human prostate cancer cell line PC3 was purchased from ATCC and was cultured in F12 Coon's with glutamine (Gibco)+10% FBS+gentamicin.

518A2: The human melanoma cancer cell line 518A2 was kindly donated by Dr. B. Jansen, Section of experimental Oncology, Molecular Pharmacology, Department of Clinical Pharmacology, University of Vienna and was cultured in DMEM (Sigma)+10% fetal bovine serum (FBS)+Glutamax I+gentamicin.

HeLa: The cervical carcinoma cell line HeLa was cultured in MEM (Sigma) containing 10% fetal bovine serum gentamicin at 37° C., 95% humidity and 5% $CO_2$.

MPC-11: The murine multiple myeloma cell line MPC-11 was purchased from ATCC and maintained in DMEM with 4 mM Glutamax+10% Horse Serum.

DU-145: The human prostate cancer cell line DU-145 was purchased from ATCC and maintained in RPMI with Glutamax+10% FBS.

RCC-4+/−VHL: The human renal cancer cell line RCC4 stably transfected with plasmid expressing VHL or empty plasmid was purchased from ECACC and maintained according to manufacturers instructions.

786-0: The human renal cell carcinoma cell line 786-0 was purchased from ATCC and maintained according to manufacturers instructions.

HUVEC: The human umbilical vein endothelial cell line HUVEC was purchased from Camcrex and maintained in EGM-2 medium.

K562: The human chronic myelogenous leukaemia cell line K562 was purchased from ECACC and maintained in RPMI with Glutamax+10% FBS. U87MG: The human glioblastoma cell line U87MG was purchased from ATCC and maintained according to the manufacturers instructions.

B16: The murine melanoma cell line B16 was purchased from ATCC and maintained according to the manufacturers instructions.

LNCap: The human prostate cancer cell line LNCap was purchased from ATCC and maintained in RPMI with Glutamax+10% FBS Huh-7: Human liver, epithelial like cultivated in Eagles MEM with 10% FBS, 2 mM Glutamax I, 1× non-essential amino acids, Gentamicin 25 µg/ml L428: (Deutsche Sammlung für Mikroorganismen (DSM, Braunschwieg, Germany)): Human B cell lymphoma maintained in RPMI 1640 supplemented with 10% FCS, L-glutamine and antibiotics.

L1236: (Deutsche Sammlung für Mikroorganismen (DSM, Braunschwieg, Germany)): Human B cell lymphoma maintained in RPMI 1640 supplemented with 10% FCS, L-glutamine and antibiotics.

Example 3

Design of a LNA AntimiR Library for all Human MicroRNA Sequences in miRBase microRNA Database The miRBase version used was version 12, as reported in Griffiths-Jones, S., Grocock, R. J., van Dongen, S., Bateman, A., Enright, A. J. 2006. miRBase: microRNA sequences, targets and gene nomenclature. Nucleic Acids Res. 34: D140-4, and available via http://microrna.sanger.ac.uk/sequences/index.shtml.

Table 1 shows 7-, 8- and 9-mer nucleotide sequences comprising the seedmer sequence of micro RNA's according to the miRBase micro RNA database. The seedmer sequence comprises the reverse complement of the microRNA seed region. In some embodiments the oligomer of the invention has a contiguous nucleotide sequence selected from the 7-mer, 8-mer or 9-mer sequences. With respect to the 7-mer, 8-mer and 9-mer sequences, in some embodiments, all the internucleoside linkages are phosphorothioate. The 7-mer, 8-mer and 9-mer nucleotide sequences may consist of sequence of nucleotide analogues as described herein, such as LNA nucleotide analogues. LNA cytosines may be methyl-cytosine (5' methyl-cytosine). In some embodiments, the LNA is beta-D-oxy-LNA.

Table 3 provides a list of microRNAs grouped into those which can be targeted by the same seedmer oligomers, such as the 7-, 8- or 9-mers provided herein (see table 1).

Figure 1:
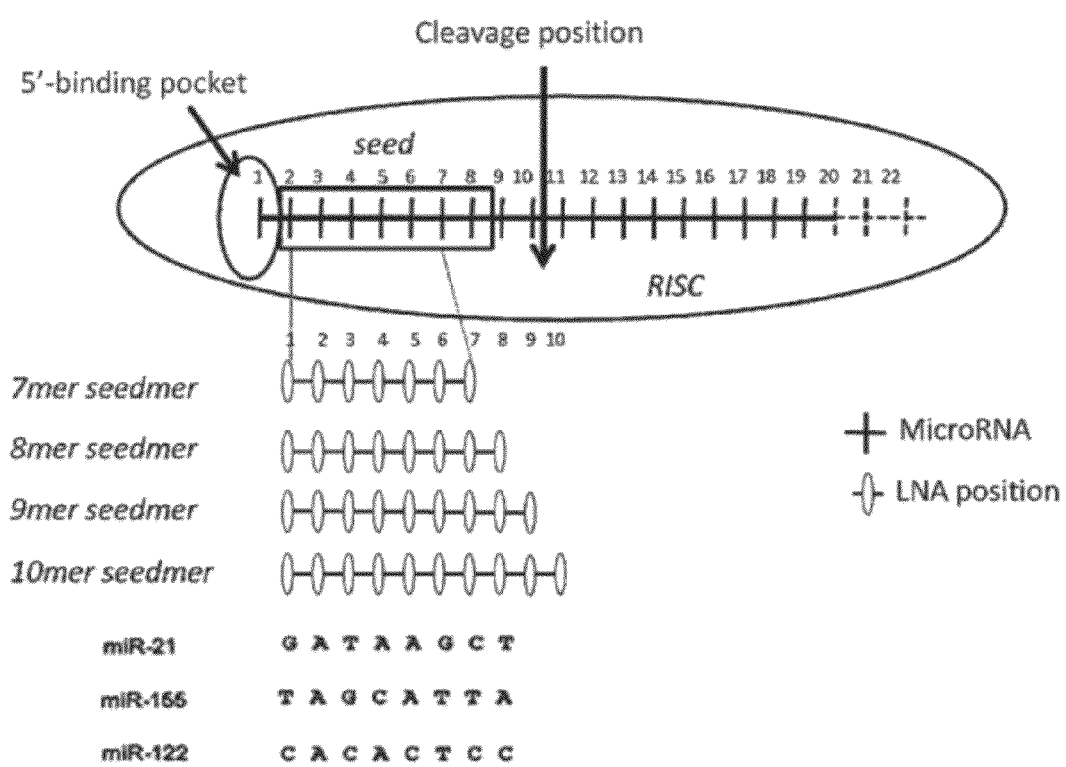
FIG. 1. Schematic presentation of the miR-21, miR-155 and miR-122 8-mer LNA-antimiRs (Compound 3205 (SEQ ID NO: 2); Compound 3207 (SEQ ID NO: 4); Compound 3208 (SEQ ID NO: 6), indicating the targeting positions with the fully LNA-modified and phosphorothiolated LNA-antimiR. Preferred hybridisation positions for 7-mer, 8-mer, 9-mer and 10-mer LNA oligonucleotides on the mature microRNA are also indicated.

TABLE 3 hsa-let-7a* (SEQ ID NO: 97), hsa-let-7f-1* (SEQ ID NO: 107)
hsa-let-7a (SEQ ID NO: 96), hsa-let-7b (SEQ ID NO: 98),
hsa-let-7c (SEQ ID NO: 100), hsa-let-7d (SEQ ID NO: 102),
hsa-let-7f (SEQ ID NO: 106), hsa-miR-98 (SEQ ID NO: 947),
hsa-let-7g (SEQ ID NO: 109), hsa-let-7i (SEQ ID NO: 111)
hsa-miR-1 (SEQ ID NO: 113), hsa-miR-206 (SEQ ID NO: 403)
hsa-miR-103 (SEQ ID NO: 118), hsa-miR-107 (SEQ ID NO: 126)
hsa-miR-10a (SEQ ID NO: 127), hsa-miR-10b (SEQ ID NO: 129)
hsa-miR-125b (SEQ ID NO: 190), hsa-miR-125a-5p (SEQ ID NO: 189)
hsa-miR-129* (SEQ ID NO: 229), hsa-miR-129-3p (SEQ ID NO: 230)
hsa-miR-130a (SEQ ID NO: 251), hsa-miR-301a (SEQ ID NO: 473),
hsa-miR-130b (SEQ ID NO: 253), hsa-miR-454 (SEQ ID NO: 608),
hsa-miR-301b (SEQ ID NO: 474)
hsa-miR-133a (SEQ ID NO: 261), hsa-miR-133b (SEQ ID NO: 262)
hsa-miR-135a (SEQ ID NO: 264), hsa-miR-135b (SEQ ID NO: 266)
hsa-miR-141 (SEQ ID NO: 278), hsa-miR-200a (SEQ ID NO: 392)
hsa-miR-146a (SEQ ID NO: 290), hsa-miR-146b-5p (SEQ ID NO: 293)
hsa-miR-152 (SEQ ID NO: 308), hsa-miR-148b (SEQ ID NO: 300)
hsa-miR-154* (SEQ ID NO: 314), hsa-miR-487a (SEQ ID NO: 619)
hsa-miR-15a (SEQ ID NO: 317), hsa-miR-16 (SEQ ID NO: 321),
hsa-miR-15b (SEQ ID NO: 319), hsa-miR-195 (SEQ ID NO: 377),
hsa-miR-497 (SEQ ID NO: 634)
hsa-miR-17 (SEQ ID NO: 324), hsa-miR-20a (SEQ ID NO: 406),
hsa-miR-93 (SEQ ID NO: 930), hsa-miR-106a (SEQ ID NO: 122),
hsa-miR-106b (SEQ ID NO: 124), hsa-miR-20b (SEQ ID NO: 408),
hsa-miR-526b* (SEQ ID NO: 708)
hsa-miR-181a (SEQ ID NO: 326), hsa-miR-181c (SEQ ID NO: 330)
hsa-miR-181b (SEQ ID NO: 329), hsa-miR-181d (SEQ ID NO: 332)
hsa-miR-18a (SEQ ID NO: 349), hsa-miR-18b (SEQ ID NO: 351)
hsa-miR-190 (SEQ ID NO: 353), hsa-miR-190b (SEQ ID NO: 357)
hsa-miR-192 (SEQ ID NO: 369), hsa-miR-215 (SEQ ID NO: 417)
hsa-miR-196a (SEQ ID NO: 379), hsa-miR-196b (SEQ ID NO: 381)
hsa-miR-199a-3p, hsa-miR-199b-3p (SEQ ID NO: 385)
hsa-miR-199a-5p (SEQ ID NO: 384), hsa-miR-199b-5p (SEQ ID NO: 386)
hsa-miR-19a* (SEQ ID NO: 388), hsa-miR-19b-1* (SEQ ID NO: 390),
hsa-miR-19b-2* (SEQ ID NO: 391)
hsa-miR-19a (SEQ ID NO: 387), hsa-miR-19b (SEQ ID NO: 389)
hsa-miR-200b (SEQ ID NO: 394), hsa-miR-200c (SEQ ID NO: 396)
hsa-miR-204 (SEQ ID NO: 401), hsa-miR-211 (SEQ ID NO: 413)
hsa-miR-208a (SEQ ID NO: 404), hsa-miR-208b (SEQ ID NO: 405)
hsa-miR-212 (SEQ ID NO: 414), hsa-miR-132 (SEQ ID NO: 255)
hsa-miR-23a* (SEQ ID NO: 440), hsa-miR-23b* (SEQ ID NO: 442)
hsa-miR-23a (SEQ ID NO: 439), hsa-miR-23b (SEQ ID NO: 441),
hsa-miR-130a* (SEQ ID NO: 252)
hsa-miR-24-1* (SEQ ID NO: 444), hsa-miR-24-2* (SEQ ID NO: 445)
hsa-miR-25 (SEQ ID NO: 446), hsa-miR-92a (SEQ ID NO: 925), TABLE 3-continued hsa-miR-367 (SEQ ID NO: 547), hsa-miR-92b (SEQ ID NO: 928)
hsa-miR-26a (SEQ ID NO: 448), hsa-miR-26b (SEQ ID NO: 451)
hsa-miR-26a-1* (SEQ ID NO: 449), hsa-miR-26a-2* (SEQ ID NO: 450)
hsa-miR-27a (SEQ ID NO: 453), hsa-miR-27b (SEQ ID NO: 455)
hsa-miR-29a (SEQ ID NO: 465), hsa-miR-29b (SEQ ID NO: 467),
hsa-miR-29c (SEQ ID NO: 470)
hsa-miR-302a (SEQ ID NO: 475), hsa-miR-302b (SEQ ID NO: 477), We have constructed an 8-mer LNA-antimiR against miR-21, miR-155 and miR-122 (designated here as micromiR) that is fully LNA modified and phosphorothiolated (see FIG. 1 and Table 6). Our results from repeated experiments in MCF-7, HeLa, Raw and Huh-7 cells using a luciferase sensor plasmid for miR-21, miR-155 and miR-122 demonstrate that the fully LNA-modified short LNA-antimiRs are highly potent in antagonizing microRNAs.

TABLE 4

LNA_antimiR & MicromiR sequences and predicted $T_m$s

| Compound | SEQ ID NO | microRNA | sequence | $T_m$ (° C.) |
|---|---|---|---|---|
| 3204 | 1 | miR-21 | T c A G t C T G a T a A g C T | 73 |
| 3205 | 2 | | G A T A A G C T | 33 |
| 3206 | 3 | miR-155 | T c A c A A T t a G C A t T A | 63 |
| 3207 | 4 | | T A G C A T T A | 45 |
| 4 | 5 | miR-122 | C c A t t G T c a C a C t C C | 73 |
| 3208 | 6 | | C A C A C T C C | 62 |

Capital letters are LNA units, such as beta-D-oxy LNA. Lower case letters are DNA units. Internucleoside linkages are preferably phosphorothioate. LNA cytosines are all preferably methylated/5-methyl cytosine.

The melting temperatures can be assessed towards the mature microRNA sequence, using a synthetic microRNA oligonucleotide (typically consisting of RNA nucleotides with a phosphodiester backbone). Typically measured $T_m$s are higher than predicted $T_m$s when using LNA oligomers against the RNA target.

Example 4

Figure 6:
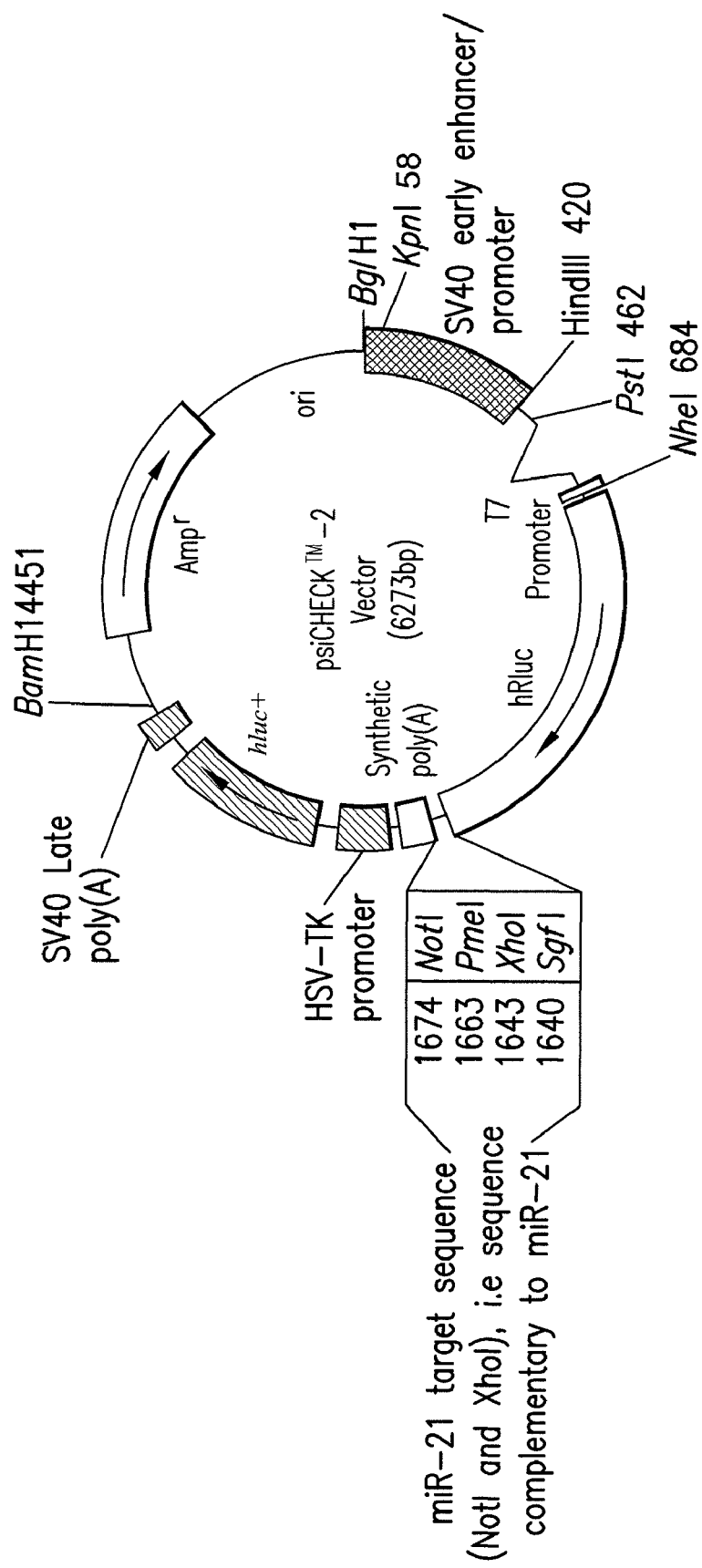
FIG. 6. Schematic presentation of the miR-21 luciferase reporter constructs.

Assessment of miR-21 Antagonism by Compound 3205 (SEQ ID NO: 2) LNA-AntimiR in MCF-7 Cells Using a Luciferase Sensor Assay In order to assess the efficiency of a fully LNA-modified 8-mer LNA-antimiR (Compound 3205, SEQ ID NO: 2) oligonucleotide in targeting and antagonizing miR-21, luciferase sensor constructs were made containing a perfect match target site for the mature miR-21 and as control, a target site with two mutations in the seed (FIG. 6). In order to monitor microRNA-21 inhibition, the breast carcinoma cell line MCF-7 was transfected with the different luciferase constructs together with the miR-21 antagonist Compound 3205 (SEQ ID NO: 2) at varying concentrations in comparison with a 15-mer LNA-antimiR Compound 3204 (SEQ ID NO: 1) against miR-21. After 24 hours, luciferase activity was measured.

Figure 2:
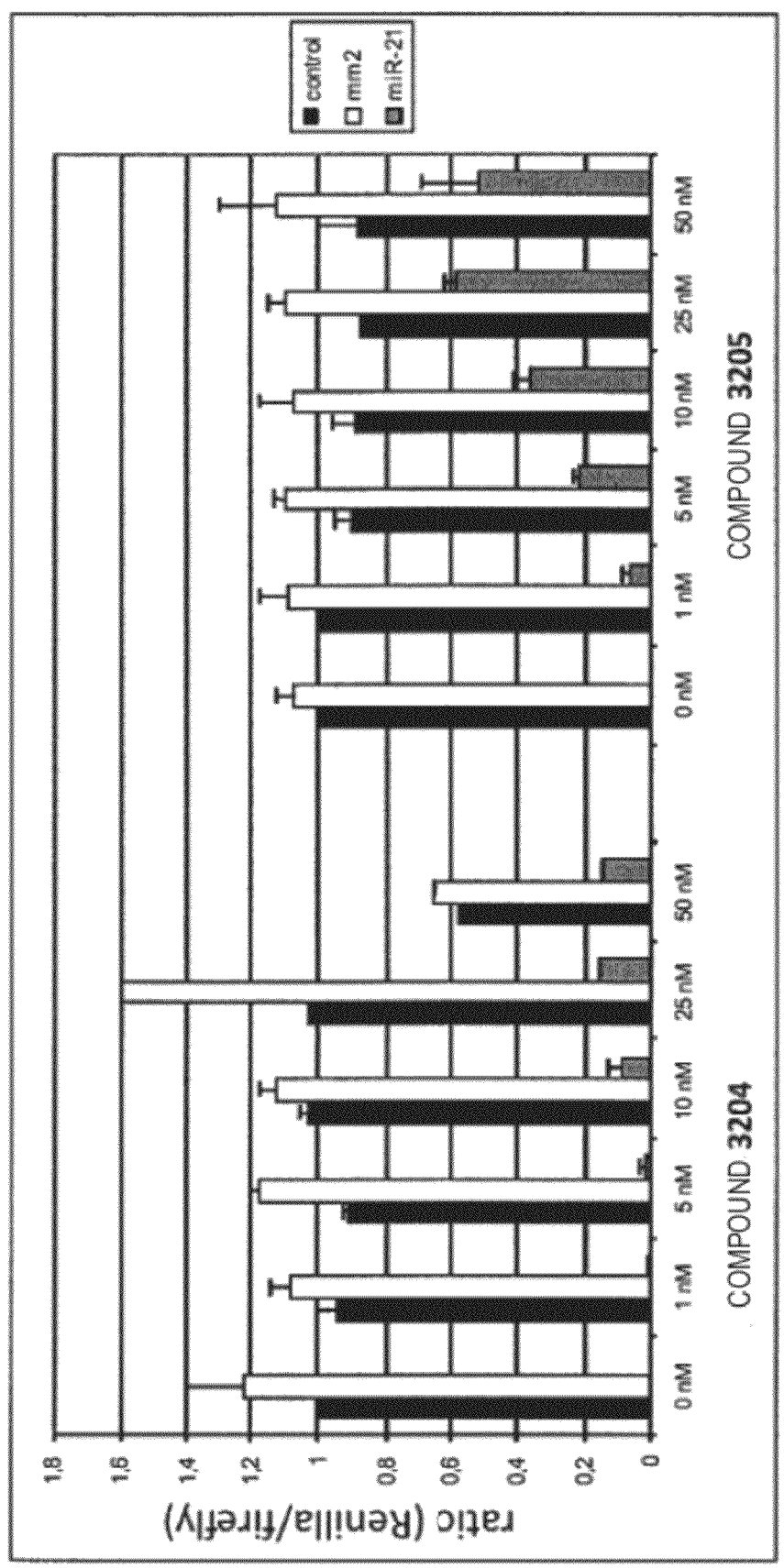
FIG. 2. Assessment of miR-21 antagonism by Compound 3205 (SEQ ID NO: 2) and Compound 3204 (SEQ ID NO: 1) LNA-antimiRs in MCF-7 cells using a luciferase sensor assay. MCF-7 cells were co-transfected with luciferase sensor plasmids containing a perfect match target site for miR-21 or a mismatch target site (.mm2) and LNA-antimiRs at different concentrations. After 24 hours, cells were harvested and luciferase activity measured. Shown are the mean of *renilla*/firefly ratios for three separate experiments (bars=s.e.m), were all have been normalized against 0 nM psiCHECK2 (=control).

Results: As seen in FIG. 2, the new fully LNA-modified 8-mer LNA-antimiR (Compound 3205 (SEQ ID NO: 2) shows two-fold higher potency compared to Compound 3204 (SEQ ID NO: 1), as shown by de-repression of the luciferase activity. By contrast, the control miR-21 sensor construct with two mismatches in the miR-21 seed did not show any de-repression of the firefly luciferase activity, thereby demonstrating the specificity of the perfect match miR-21 sensor in monitoring miR-21 activity in cells. The de-repression of luciferase activity by the 8-mer LNA-antimiR is clearly dose-dependent, which is not seen with Compound 3204 (SEQ ID TABLE 3-continued hsa-miR-302c (SEQ ID NO: 479), hsa-miR-302d (SEQ ID NO: 481),
hsa-miR-373 (SEQ ID NO: 555), hsa-miR-520e (SEQ ID NO: 696),
hsa-miR-520a-3p (SEQ ID NO: 690), hsa-miR-520b (SEQ ID NO: 692),
hsa-miR-520c-3p (SEQ ID NO: 693), hsa-miR-520d-3p (SEQ ID NO: 694)
hsa-miR-302b* (SEQ ID NO: 478), hsa-miR-302d* (SEQ ID NO: 482)
hsa-miR-30a* (SEQ ID NO: 486), hsa-miR-30d* (SEQ ID NO: 493),
hsa-miR-30e* (SEQ ID NO: 495)
hsa-miR-30a (SEQ ID NO: 485), hsa-miR-30c (SEQ ID NO: 489),
hsa-miR-30d (SEQ ID NO: 492), hsa-miR-30b (SEQ ID NO: 487),
hsa-miR-30e (SEQ ID NO: 494)
hsa-miR-330-5p (SEQ ID NO: 513), hsa-miR-326 (SEQ ID NO: 509)
hsa-miR-34a (SEQ ID NO: 534), hsa-miR-34c-5p (SEQ ID NO: 539),
hsa-miR-449a (SEQ ID NO: 599), hsa-miR-449b (SEQ ID NO: 600)
hsa-miR-362-3p (SEQ ID NO: 542), hsa-miR-329 (SEQ ID NO: 511)
hsa-miR-374a (SEQ ID NO: 557), hsa-miR-374b (SEQ ID NO: 559)
hsa-miR-376a (SEQ ID NO: 562), hsa-miR-376b (SEQ ID NO: 564)
hsa-miR-378 (SEQ ID NO: 568), hsa-miR-422a (SEQ ID NO: 585)
hsa-miR-379* (SEQ ID NO: 571), hsa-miR-411* (SEQ ID NO: 582)
hsa-miR-381 (SEQ ID NO: 574), hsa-miR-300 (SEQ ID NO: 472)
hsa-miR-509-5p (SEQ ID NO: 655), hsa-miR-509-3-5p (SEQ ID NO: 653)
hsa-miR-515-5p (SEQ ID NO: 666), hsa-miR-519e* (SEQ ID NO: 689)
hsa-miR-516b*, hsa-miR-516a-3p (SEQ ID NO: 667)
hsa-miR-517a (SEQ ID NO: 671), hsa-miR-517c (SEQ ID NO: 673)
hsa-miR-518a-5p (SEQ ID NO: 674), hsa-miR-527 (SEQ ID NO: 709)
hsa-miR-518f (SEQ ID NO: 681), hsa-miR-518b (SEQ ID NO: 675),
hsa-miR-518c (SEQ ID NO: 676), hsa-miR-518a-3p (SEQ ID NO: 674),
hsa-miR-518d-3p (SEQ ID NO: 678)
hsa-miR-519c-3p (SEQ ID NO: 686), hsa-miR-519b-3p (SEQ ID NO: 685),
hsa-miR-519a (SEQ ID NO: 683)
hsa-miR-519c-5p, hsa-miR-519b-5p, hsa-miR-523*, hsa-miR-518f*
(SEQ ID NO: 682), hsa-miR-526a, hsa-miR-520c-5p, hsa-miR-518e*,
hsa-miR-518d-5p (SEQ ID NO: 679), hsa-miR-522*,
hsa-miR-519a* (SEQ ID NO: 684)
hsa-miR-519e (SEQ ID NO: 688), hsa-miR-33b* (SEQ ID NO: 527)
hsa-miR-520a-5p (SEQ ID NO: 691), hsa-miR-525-5p (SEQ ID NO: 706)
hsa-miR-520g (SEQ ID NO: 698), hsa-miR-520h (SEQ ID NO: 699)
hsa-miR-524-5p (SEQ ID NO: 704), hsa-miR-520d-5p (SEQ ID NO: 695)
hsa-miR-525-3p (SEQ ID NO: 705), hsa-miR-524-3p (SEQ ID NO: 703)
hsa-miR-548b-5p (SEQ ID NO: 724), hsa-miR-548a-5p (SEQ ID NO: 722),
hsa-miR-548c-5p (SEQ ID NO: 726), hsa-miR-548d-5p (SEQ ID NO: 728)
hsa-miR-7-1* (SEQ ID NO: 880), hsa-miR-7-2* (SEQ ID NO: 881)
hsa-miR-99a (SEQ ID NO: 948), hsa-miR-100 (SEQ ID NO: 114),
hsa-miR-99b (SEQ ID NO: 950)

NO: 1). Moreover, the new 8-mer is also much more potent at lower doses than Compound 3204 (SEQ ID NO: 1).

To conclude, the 8-mer LNA-antimiR Compound 3205 (SEQ ID NO: 2) shows significantly improved potency in inhibition of miR-21 in vitro compared to the 15-mer LNA-antimiR Compound 3204 (SEQ ID NO: 1) targeting miR-21.
Materials and Methods:

Cell line: The breast carcinoma cell line MCF-7 was purchased from ATCC (#HTB-22™). MCF-7 cells were cultured in EMEM medium, supplemented with 10% fetal bovine serum, 2 mM Glutamax, 1×NEAA and 25 ug/ml Gentamicin.

Transfection: 400.000 cells were seeded per well in a 6-well plate the day before transfection in order to receive 50-70% confluency the next day. On the day of transfection, MCF-7 cells were transfected with 0.8 ug miR-21 perfect match/psiCHECK2, miR-21.mm2/psiCHECK2 or empty psiCHECK2 vector (SDS Promega) together with 1 µl Lipofectamine-2000 (Invitrogen) according to manufacturer's instructions. After 24 hours, cells were harvested for luciferase measurements.

Luciferase assay: The cells were washed with PBS and harvested with cell scraper, after which cells were centrifugated for 5 min at 10.000 rpm. The supernatant was discarded and 50 µl 1× Passive Lysis Buffer (Promega) was added to the cell pellet, after which cells were put on ice for 30 min. The lysed cells were spinned at 10.000 rpm for 30 min after which 20 µl were transferred to a 96 well plate and luciferase measurements were performed according to manufacturer's instructions (Promega).

Example 5

Figure 3:
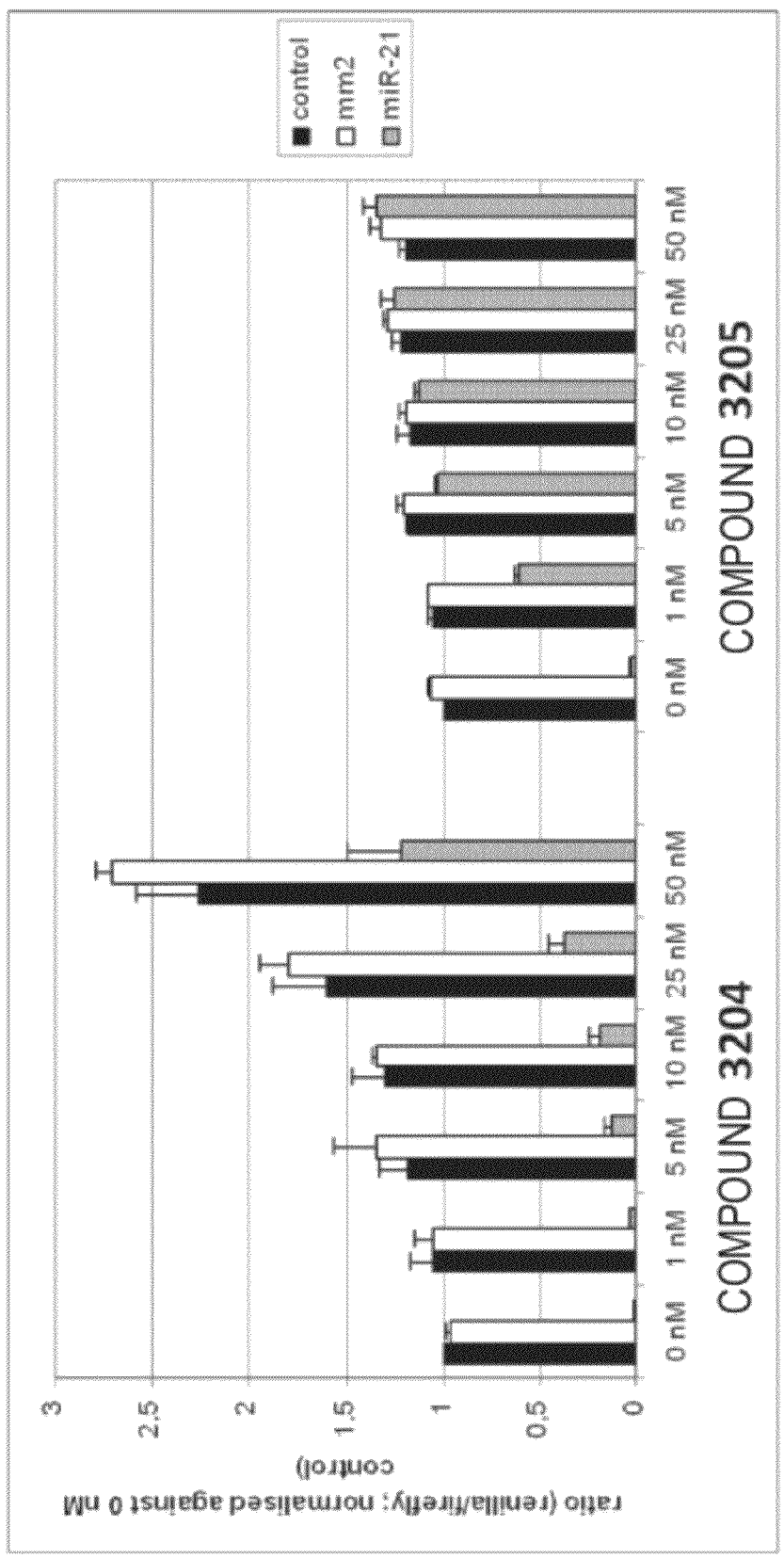
FIG. 3. Assessment of miR-21 antagonism by Compound 3205 (SEQ ID NO: 2) and Compound 3204 (SEQ ID NO: 1) LNA-antimiRs in HeLa cells using a luciferase sensor assay. HeLa cells were co-transfected with luciferase sensor plasmids containing a perfect match target site for miR-21 (mir-21) or a mismatch target site (mm2) and LNA-antimiRs at different concentrations. After 24 hours, cells were harvested and luciferase activity measured. Shown are the mean of *renilla*/firefly ratios for three separate experiments (bars=s.e.m), were all have been normalized against 0 nM psiCHECK2 (=control).

Assessment of miR-21 Antagonism by Compound 3205 (SEQ ID NO: 2) LNA-AntimiR in HeLa Cells Using a Luciferase Sensor Assay To further assess the efficiency of the fully LNA-modified 8-mer LNA-antimiR Compound 3205 (SEQ ID NO: 2) in targeting miR-21, the cervix carcinoma cell line HeLa was also transfected with the previously described miR-21 luciferase sensor constructs alongside Compound 3205 (SEQ ID NO: 2) at varying concentrations as described in the above section (FIG. 3).

Results: Compound 3205 (SEQ ID NO: 2) shows complete de-repression of the miR-21 luciferase sensor construct in HeLa cells already at 5 nM compared to Compound 3204 (SEQ ID NO: 1), which did not show complete de-repression until the highest dose (50 nM). In addition, antagonism of miR-21 by the 8-mer Compound 3205 (SEQ ID NO: 2) LNA-antimiR is dose-dependent. To demonstrate the specificity of the miR-21 luciferase sensor assay, a mismatched miR-21 target site (2 mismatches in seed) was also transfected into HeLa cells, but did not show any de-repression of the firefly luciferase activity.

To conclude, the fully LNA-modified Compound 3205 (SEQ ID NO: 2) shows significantly improved potency in inhibition of miR-21 in vitro, in both MCF-7 and HeLa cells compared to the 15-mer LNA-antimiR Compound 3204 (SEQ ID NO: 1).
Materials and Methods:

Cell line: The human cervix carcinoma cell line HeLa was purchased from ECACC (#93021013). HeLa cells were cultured in EMEM medium, supplemented with 10% fetal bovine serum, 2 mM Glutamax, 1×NEAA and 25 ug/ml Gentamicin.

Transfection: 60.000 cells were seeded per well in a 24 well plate the day before transfection in order to receive 50-70% confluency the next day. On the day of transfection, HeLa cells were transfected with 0.2 ug miR-21 perfect match/psiCHECK2, miR-21.mm2/psiCHECK2 or empty psiCHECK2 vector together with 0.7 µl Lipofectamine2000 (Invitrogen) according to manufacturer's instructions. After 24 hours, cells were harvested for luciferase measurements.

Luciferase assay: The cells were washed with PBS and 100 µl 1× Passive Lysis Buffer (Promega) was added to each well, after which the 24 well plates was put on an orbital shaker for 30 min. The cells were collected and transferred to an eppendorf tube and spinned at 10.000 rpm for 30 min after which 10 µl were transferred to a 96 well plate and luciferase measurements were performed according to manufacturer's instructions (Promega).

Example 6

Assessment of miR-155 Antagonism by Compound 3207 (SEQ ID NO: 4) LNA-AntimiR in Mouse RAW Cells Using a Luciferase Sensor Assay To ask whether a fully LNA-modified 8-mer LNA-antimiR can effectively antagonize miR-155, a perfect match target site for miR-155 was cloned into the same luciferase vector (psiCHECK2) and transfected into the mouse leukaemic monocyte macrophage RAW cell line. Because the endogenous levels of miR-155 are low in the RAW cell line, the cells were treated with 100 ng/ml LPS for 24 hours in order to induce miR-155 accumulation.

Figure 4:
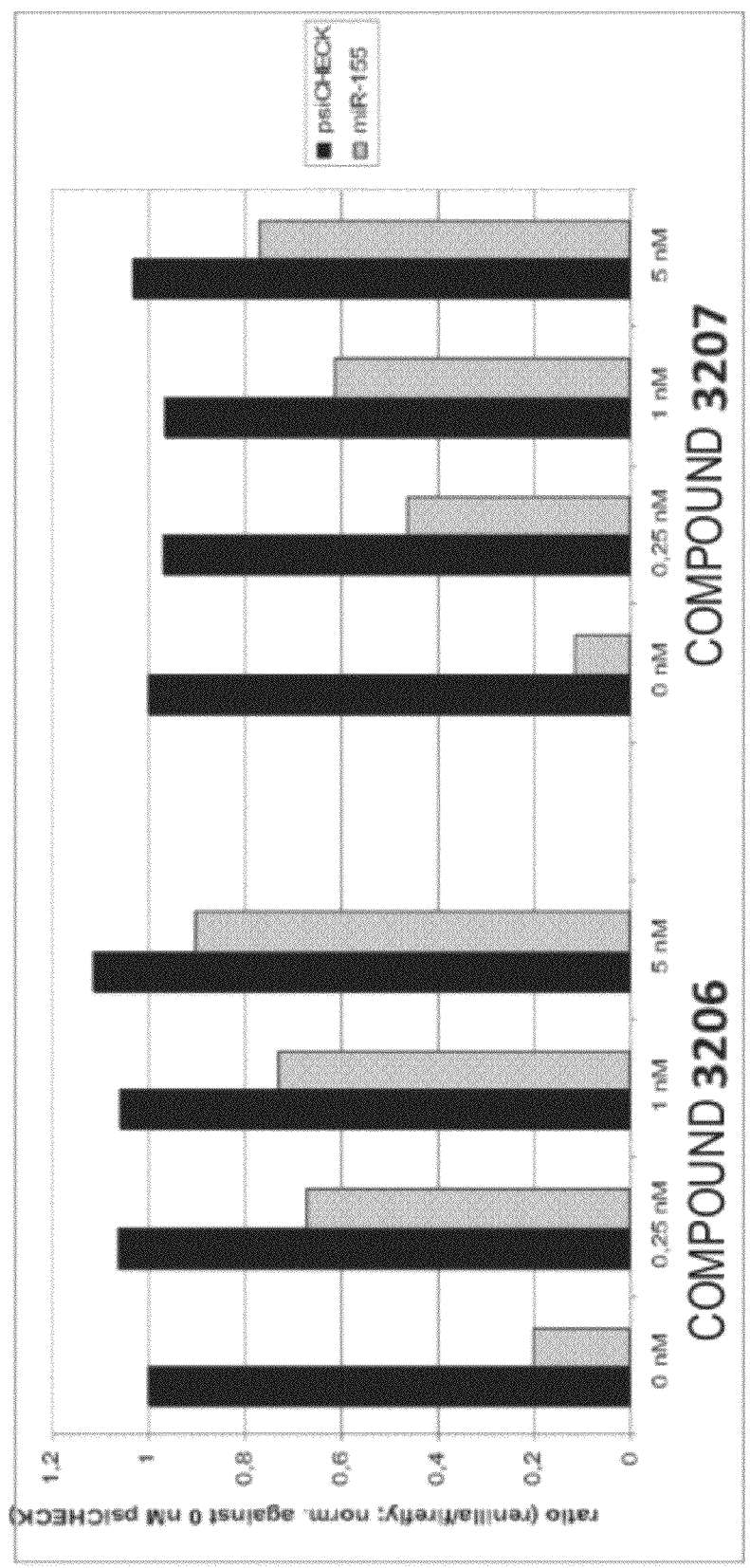
FIG. 4. Assessment of miR-155 antagonism by Compound 3206 (SEQ ID NO: 3) and Compound 3207 (SEQ ID NO: 4) LNA-antimiRs in LPS-treated mouse RAW cells using a luciferase sensor assay. RAW cells were co-transfected with miR-155 and the different LNA-antimiRs at different concentrations. After 24 hours, cells were harvested and luciferase activity measured. Shown are the mean of *renilla*/firefly, were all have been normalized against 0 nM psiCHECK2.

Results: Luciferase measurements showed that the fully LNA-modified 8-mer LNA-antimiR Compound 3207 (SEQ ID NO: 4) targeting miR-155 was similarly effective in antagonizing miR-155 compared to the 15-mer LNA-antimiR Compound 3206 (SEQ ID NO: 3) (FIG. 4). Both LNA-antimiRs showed a >50% de-repression of the miR-155 luciferase sensor at 0.25 nM concentration and inhibited miR-155 in a dose-dependent manner.

Conclusion: These data further support the results from antagonizing miR-21, as shown in examples 1 and 2, demonstrating that a fully thiolated 8-mer LNA-antimiR is highly potent in microRNA targeting.
Materials and Methods:

Cell line: The mouse leukaemic monocyte macrophage RAW 264.7 was purchased from ATCC (TIB-71). RAW cells were cultured in DMEM medium, supplemented with 10% fetal bovine serum, 4 mM Glutamax and 25 ug/ml Gentamicin.

Transfection: 500.000 cells were seeded per well in a 6 well plate the day before transfection in order to receive 50% confluency the next day. On the day of transfection, MCF-7 cells were transfected with 0.3 ug miR-155 or empty psiCHECK2 vector together with 10 µl Lipofectamine2000 (Invitrogen) according to manufacturer's instructions. In order to induce miR-155 accumulation, LPS (100 ng/ml) was added to the RAW cells after the 4 hour incubation with the transfection complexes. After another 24 hours, cells were harvested for luciferase measurements.

Luciferase assay: The cells were washed with PBS and harvested with cell scraper, after which cells were centrifugated for 5 min at 2.500 rpm. The supernatant were discarded and 50 µl 1× Passive Lysis Buffer (Promega) was added to the cell pellet, after which cells were put on ice for 30 min. The lysed cells were spinned at 10.000 rpm for 30 min after which 20 µl were transferred to a 96 well plate and luciferase measurements were performed according to manufacturer's instructions (Promega).

Example 7

Figure 5:
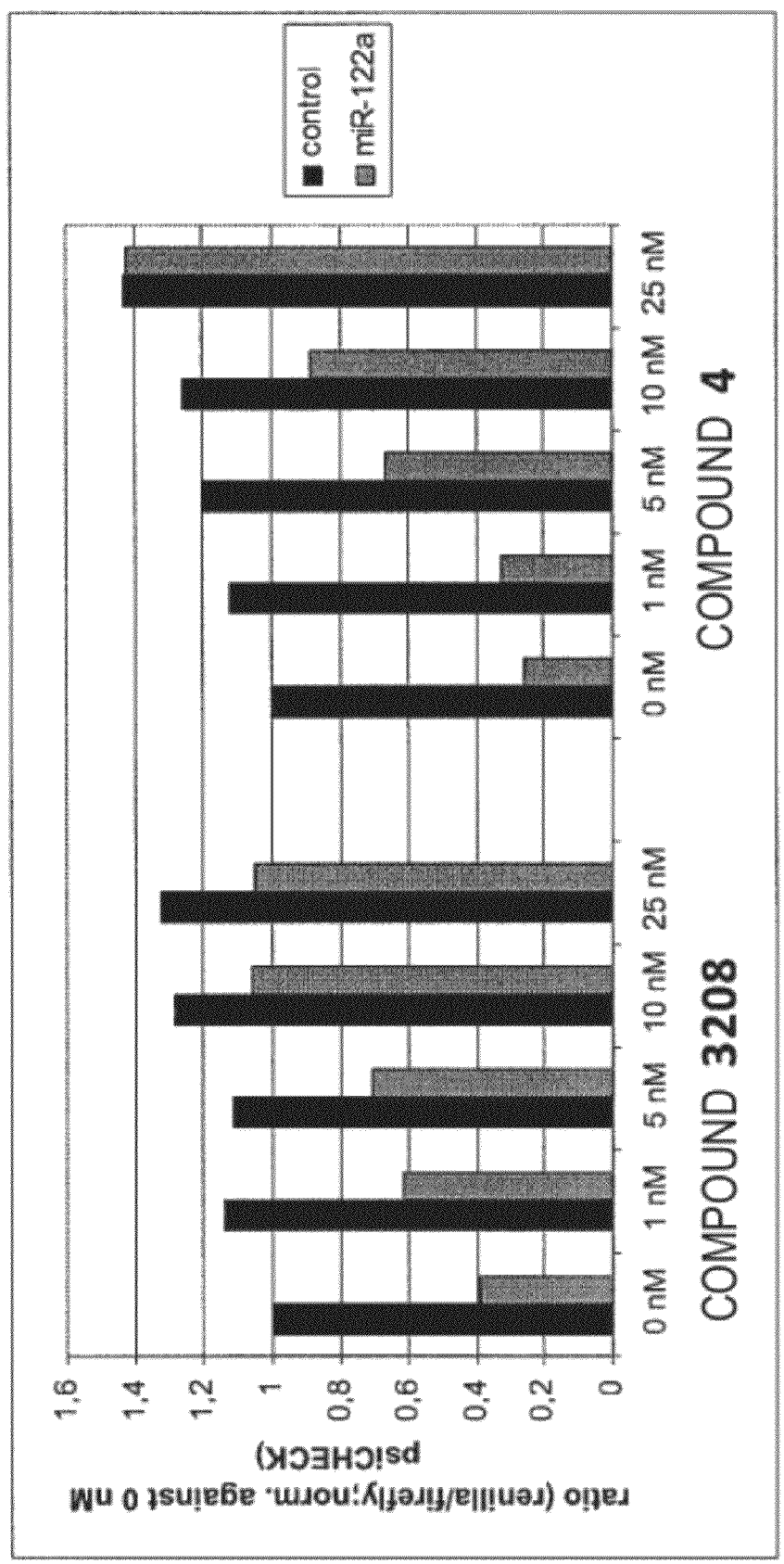
FIG. 5. Assessment of miR-122 antagonism by Compound 3208 (SEQ ID NO: 6) and Compound 4 (SEQ ID NO: 5) LNA-antimiRs in HuH-7 cells using a luciferase sensor assay. HuH-7 cells were co-transfected with a miR-122 luciferase sensor containing a perfect match miR-122 target site and the different LNA-antimiRs at different concentrations. After 24 hours, cells were harvested and luciferase activity measured. Shown are the mean of *renilla*/firefly ratios for three separate experiments (bars=s.e.m), where all have been normalized against 0 nM psiCHECK2 (=control).

Assessment of miR-122 Antagonism by Compound 3208 (SEQ ID NO: 6) LNA-AntimiR in HuH-7 Cells Using a Luciferase Sensor Assay The potency of the fully modified 8-mer LNA-antimiR Compound 3208 (SEQ ID NO: 6) against miR-122 was assessed in the human hepatoma cell line HuH-7. The HuH-7 cells were transfected with luciferase sensor construct containing a perfect match miR-122 target site. After 24 hours luciferase measurements were performed (FIG. 5).

Results: The fully LNA-modified 8-mer LNA-antimiR Compound 3208 (SEQ ID NO: 6) is more potent than the 15-mer LNA-antimiR Compound 4 (SEQ ID NO:5) at low concentration, as shown by de-repression of the miR-122 luciferase sensor. Both LNA-antimiRs inhibit miR-122 in a dose-depenedt manner (FIG. 5).

Conclusion: The fully LNA-modified 8-mer LNA-antimiR Compound 3208 (SEQ ID NO: 6) targeting miR-122 shows improved potency in inhibition of miR-122 in vitro.

Materials and Methods:

Cell line: The human hepatoma cell line HuH-7 was a kind gift from R. Bartenschlager, Heidelberg. Huh-7 cells were cultured in EMEM medium, supplemented with 10% fetal bovine serum, 2 mM Glutamax, 1×NEAA and 25 ug/ml Gentamicin.

Transfection: 8.000 cells were seeded per well in a 96 well plate the day before transfection in order to receive 50-70% confluency the next day. On the day of transfection, HuH-7 cells were transfected with 57 ng miR-122 or empty psiCHECK2 vector together with 1 µl Lipofectamine2000 (Invitrogen). After 24 hours, cells were harvested for luciferase measurements.

Luciferase assay: 50 µl 1× Passive Lysis Buffer (Promega) was added to each well, after which the 96 well plate was put on an orbital shaker for 30 min. To each well the Dual-luciferase Reporter assay system (Promega) was added and luciferase measurements were performed according to manufacturer's instructions (Promega).

Example 8

Assessment of miR-21 Antagonism by Comparing an 8-mer (Compound 3205, SEQ ID NO: 2) versus a 15-mer (Compound 3204, SEQ ID NO: 1) LNA-AntimiR in Human Prostate Carcinoma Cells (PC3)

Figure 7:
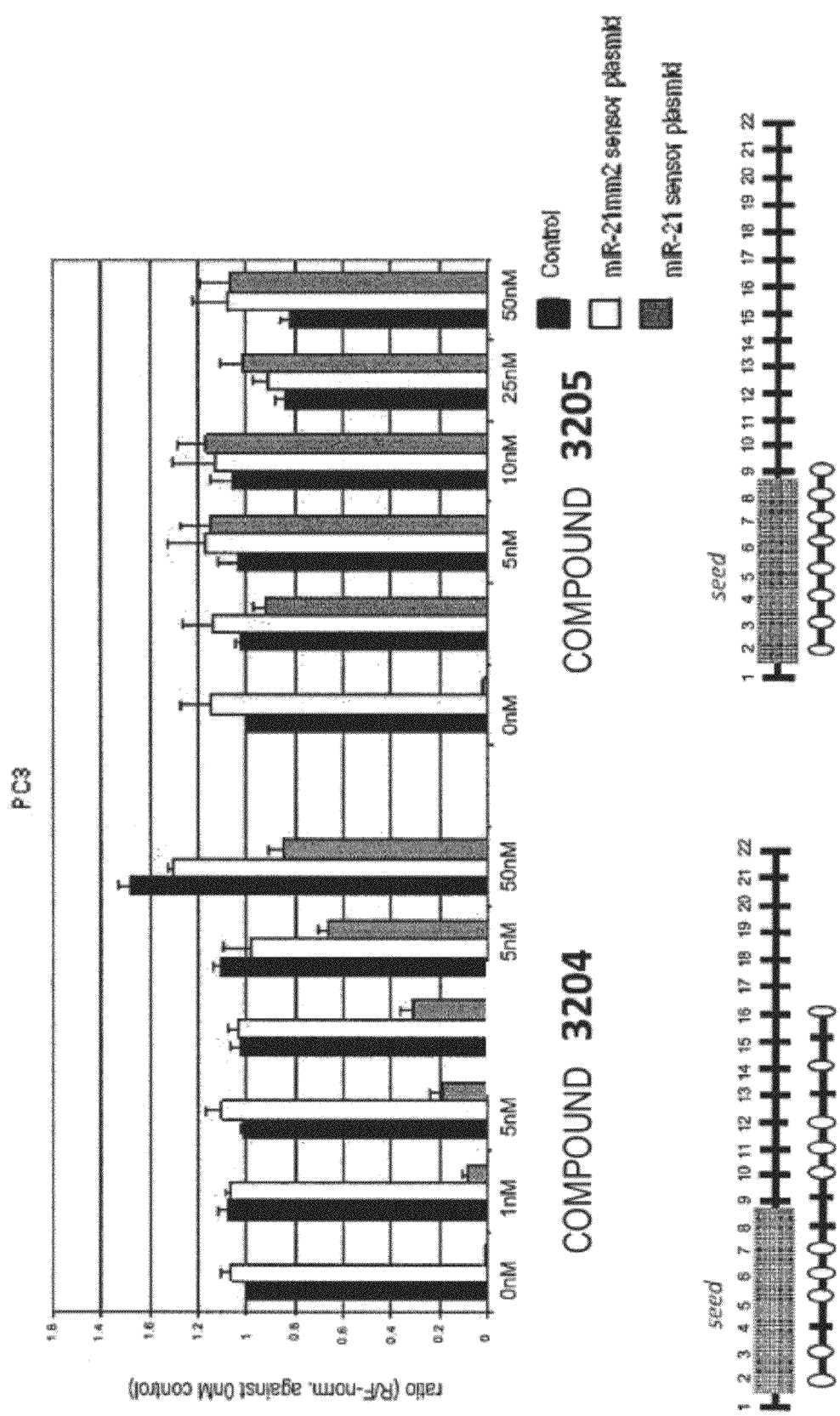
FIG. 7. Assessment of miR-21 antagonism by an 8-mer LNA-antimiR Compound 3205 (SEQ ID NO: 2) versus a 15-mer LNA-antimiR Compound 3204 (SEQ ID NO: 1) in PC3 cells using a luciferase reporter assay. PC3 cells were co-transfected with luciferase reporter plasmids containing a perfect match target site for miR-21 or a mismatch target site and LNA-antimiRs at different concentrations. After 24 hours, cells were harvested and luciferase activity measured. Shown are the mean values (bars=s.e.m) of three independent experiments where the *renilla*/firefly ratios have been normalized against 0 nM empty vector without target site (=control). Shown is also a schematic presentation of the miR-21 sequence and the design and position of the LNA-antimiRs. LNA nucleotides are indicated by ovals, and DNA residues are indicated by bars.

We have previously shown (patent application 1051), that an 8-mer LNA-antimiR that is fully LNA-modified and phosphorothiolated is able to completely de-repress the miR-21 luciferase reporter levels in the human cervix carcinoma cell line HeLa and partly de-repress the miR-21 luciferase reporter levels in the human breast carcinoma cell line MCF-7. We next extended this screening approach to the human prostate cancer cell line PC3. To assess the efficiency of the different LNA-antimiR oligonucleotides against miR-21, luciferase reporter constructs were generated in which a perfect match target site for the mature miR-21 and a target site with two mismatches in the seed were cloned in the 3'UTR of Renilla luciferase gene (FIG. 7). In order to monitor miR-21 inhibition, PC3 cells were transfected with the different luciferase constructs together with the miR-21 antagonist Compound 3205 (SEQ ID NO: 2) (8-mer) and for comparison with the 15-mer LNA-antimiR perfect match Compound 3204 (SEQ ID NO: 1) at varying concentrations. After 24 hours, luciferase activity was measured.

Results: The luciferase reporter experiments showed a dose-dependent de-repression of the luciferase miR-21 reporter activity with the 15-mer LNA-antimiR against miR-21 (Compound 3204, SEQ ID NO: 1). However, complete de-repression of the luciferase reporter was not obtained even at the highest concentrations (FIG. 7). In contrast, the cells that were transfected with the 8-mer fully LNA substituted LNA-antimiR showed complete de-repression already at 1 nM, indicating significantly improved potency compared to the 15-mer LNA-antimiR. The luciferase control reporter harboring a mismatch target site for miR-21 was not affected by either LNA-antimiR, demonstrating high specificity of both LNA-antimiRs.

Conclusion: The micromer is far more potent than the 15-mer LNA-antimiR in targeting miR-21 and has so far shown to be most potent in prostate carcinoma cells.

Materials and Methods:

Cell line: The human prostate carcinoma PC3 cell line was purchased from ECACC (#90112714). PC3 cells were cultured in DMEM medium, supplemented with 10% fetal bovine serum, 2 mM Glutamax and 25 ug/ml Gentamicin.

Transfection: 100.000 cells were seeded per well in a 12-well plate the day before transfection in order to receive 50% confluency the next day. On the day of transfection, PC3 cells were transfected with 0.3 mg miR-21 or empty psiCHECK2 vector together with 1.2 µl Lipofectamine2000 (Invitrogen) according to manufacturer's instructions. Transfected was also varying concentrations of LNA-antimiRs. After 24 hours, cells were harvested for luciferase measurements.

Luciferase assay: The cells were washed with PBS and 250 µl 1× Passive Lysis Buffer (Promega) was added to the wells. The plates were placed on a shaker for 30 min., after which the cell lysates were transferred to eppendorf tubes. The cell lysate was centrifugated for 10 min at 2.500 rpm after which 20 µl were transferred to a 96 well plate and luciferase measurements were performed according to manufacturer's instructions (Promega).

Example 9

Specificity Assessment of miR-21 Antagonism by an 8-mer LNA-AntimiR

Figure 8:
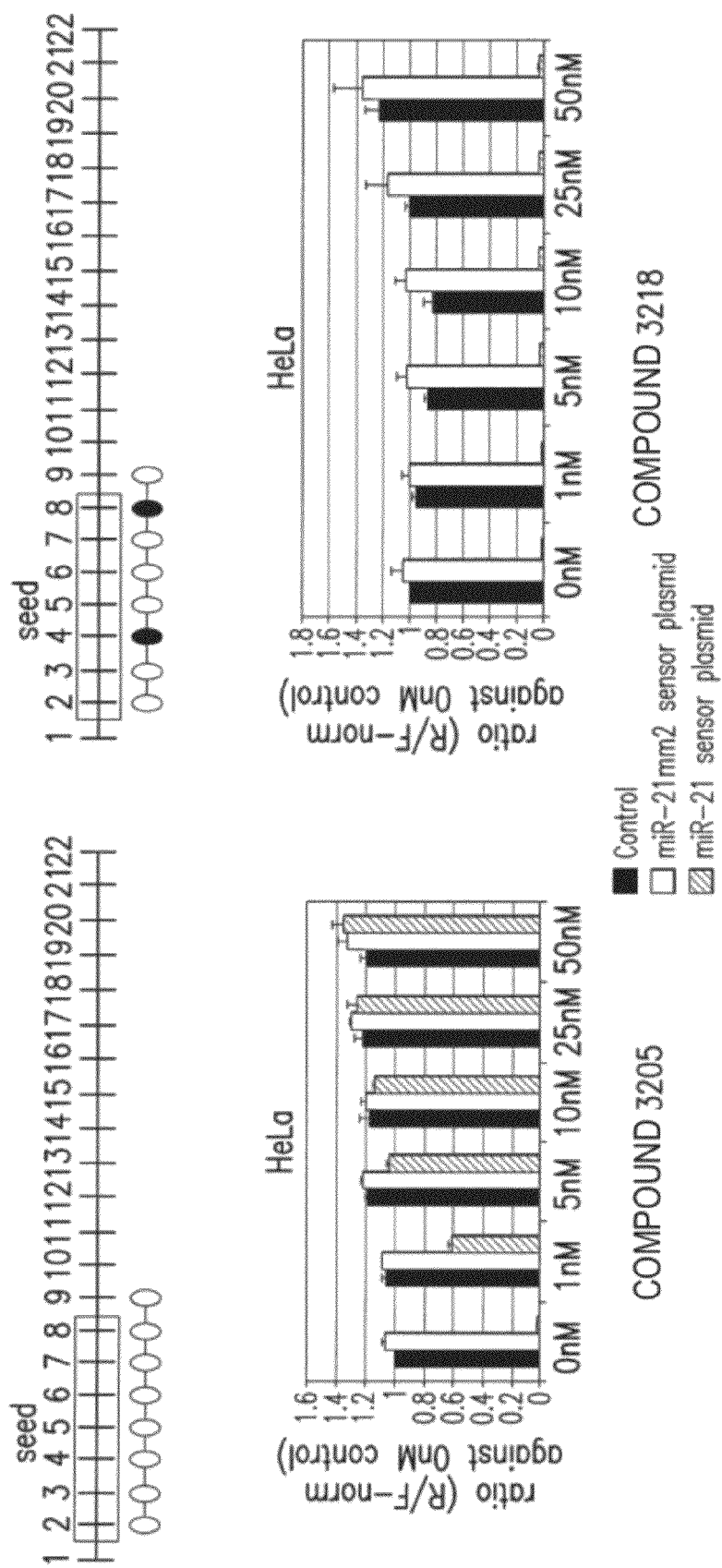
FIG. 8. Specificity assessment of miR-21 antagonism by an 8-mer LNA-antimiR in HeLa cells using a luciferase reporter assay. HeLa cells were co-transfected with luciferase reporter plasmids containing a perfect match or a mismatched target site for miR-21 and LNA-antimiRs Compound 3205 (SEQ ID NO: 2) or an 8-mer LNA mismatch control oligo Compound 3218 (SEQ ID NO: 16) at different concentrations. After 24 hours, cells were harvested and luciferase activity was measured. Shown are the mean values (bars=s.e.m) for three independent experiments where the *Renilla*/firefly ratios have been normalized against 0 nM empty vector without target site (=control). Shown is also a schematic presentation of the miR-21 sequence and the design and position of the LNA-antimiRs. Mismatches are indicated by filled ovals.

To investigate the specificity of our short LNA-antimiR targeting miR-21, we designed an 8-mer mismatch control LNA-antimiR (Compound 3218, SEQ ID NO: 16) containing 2 mismatches in the seed recognition sequence (see FIG. 8). The luciferase reporter constructs described in example 1 were transfected into the human cervix carcinoma cell line HeLa together with the LNA mismatch control oligo Compound 3218 (SEQ ID NO: 16) and its efficacy was compared with the 8-mer LNA-antimiR (Compound 3205, SEQ ID NO: 2) targeting miR-21. After 24 hours, luciferase activity was measured.

Results: As shown in FIG. 8, transfection of the fully LNA-modified 8-mer LNA-antimiR in HeLa cells resulted in complete de-repression of the luciferase miR-21 reporter already at 5 nM. In contrast, when the cells were transfected with the 8-mer LNA mismatch control oligo, combined with the results obtained with the control miR-21 luciferase reporter having two mismatches in the miR-21 seed, these data demonstrate high specificity of the fully LNA-substituted 8-mer LNA-antimiR in targeting miR-21 in Hela cells.

Analysis of the miRBase microRNA sequence database showed that the miR-21 recognition sequence, of the LNA-antimiR Compound 3205 (SEQ ID NO: 2) is unique for microRNA-21. However, when decreasing the micromer length to 7 nt, it is not specific for only miR-21, since ath-miR-844, mmu-miR-590-3p and has-miR-590-3p are also targeted.

Conclusion: Exhanging two nucleotide positions within the 8-mer LNA-antimiR with two mismatching nucleotides completely abolished the antagonizing activity of the LNA-antimiR for miR-21.

Materials and Methods:

Cell line: The human cervix carcinoma cell line HeLa was purchased from ECACC (#93021013). HeLa cells were cultured in EMEM medium, supplemented with 10% fetal bovine serum, 2 mM Glutamax, 1×NEAA and 25 ug/ml Gentamicin.

Transfection: 60.000 cells were seeded per well in a 24-well plate the day before transfection in order to receive 50-70% confluency the next day. On the day of transfection, HeLa cells were transfected with 0.2 ug miR-21 perfect match/psiCHECK2, miR-21.mm2/psiCHECK2 or empty psiCHECK2 vector together with 0.7 µl Lipofectamine2000 (Invitrogen) according to manufacturer's instructions. Transfected was also varying concentrations of LNA-antimiRs. After 24 hours, cells were harvested for luciferase measurements.

Luciferase assay: The cells were washed with PBS and 100 µl 1× Passive Lysis Buffer (Promega) was added to each well, after which the 24-well plates were put on an orbital shaker for 30 min. The cells were collected and transferred to an eppendorf tube and spinned at 10.000 rpm for 30 min after which 10 µl were transferred to a 96-well plate and luciferase measurements were performed according to manufacturer's instructions (Promega).

Example 10

Assessment of the Shortest Possible Length of a Fully LNA-Modified LNA-AntimiR that Mediates Effective Antagonism of miR-21

To further investigate the LNA-antimiR length requirements, we designed a 7-mer and a 6-mer LNA-antimiR targeting miR-21, both fully LNA-modified and phosphorothiolated oligonucleotides. The miR-21 luciferase reporter constructs were transfected into HeLa cells along with the LNA-antimiRs at varying concentrations. Luciferase measurements were performed after 24 hours.

Figure 9:
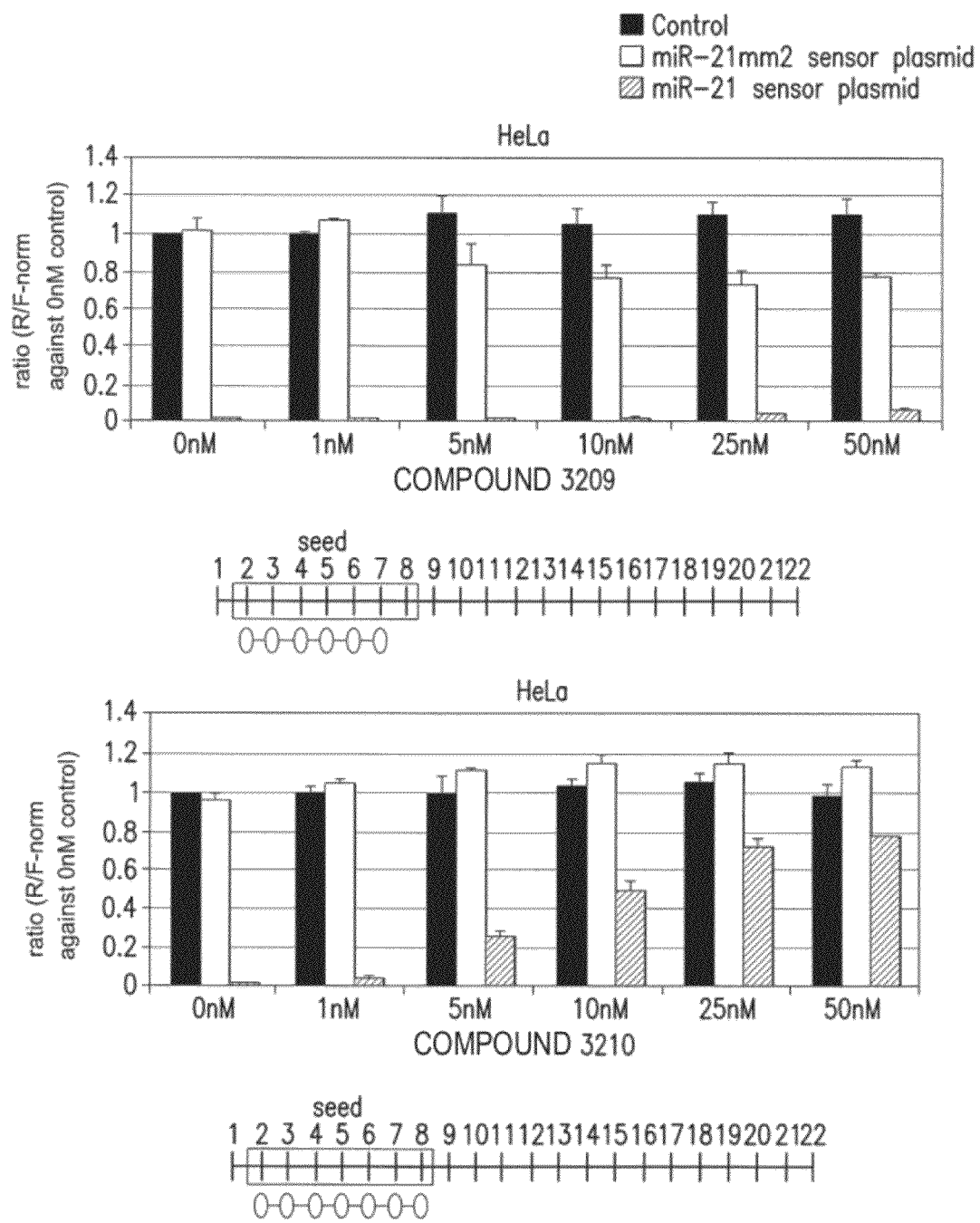
FIG. 9. Assessment of the shortest possible length of a fully LNA-modified LNA-antimiR that mediates effective antagonism of miR-21. HeLa cells were co-transfected with luciferase reporter plasmids containing a perfect match or a mismatch target site for miR-21 and the LNA-antimiRs at different concentrations (Compound 3209=6-mer (SEQ ID NO: 7) and Compound 3210=7-mer (SEQ ID NO: 8)). After 24 hours, cells were harvested and luciferase activity measured. Shown are the mean values (bars=s.e.m) for three independent experiments where the *renilla*/firefly ratios have been normalized against 0 nM empty vector without target site (=control). Shown is also a schematic presentation of the miR-21 sequence and the design and position of the LNA-antimiRs.

Results: As seen in FIG. 9, the 7-mer LNA-antimiR mediates de-repression of the miR-21 luciferase reporter plasmid, but at lower potency compared to the 8-mer LNA-antimiR (Compound 3205, SEQ ID NO: 2). Nevertheless, a dose-dependent trend can still be observed. By contrast, the 6-mer LNA-antimiR did not show any inhibitory activity.

Conclusion: To conclude, the shortest possible length of an LNA-antimiR which is able to mediate miR-21 inhibition is 7 nucleotides. However, the 7-mer LNA-antimiR is less potent compared to the 8-mer LNA-antimiR for miR-21.

Materials and Methods:

Cell line: The human cervix carcinoma cell line HeLa was purchased from ECACC (#93021013). HeLa cells were cultured in EMEM medium, supplemented with 10% fetal bovine serum, 2 mM Glutamax, 1×NEAA and 25 ug/ml Gentamicin.

Transfection: 60.000 cells were seeded per well in a 24 well plate the day before transfection in order to receive 50-70% confluency the next day. On the day of transfection, HeLa cells were transfected with 0.2 ug miR-21 perfect match/psiCHECK2, miR-21.mm2/psiCHECK2 or empty psiCHECK2 vector together with 0.7 µl Lipofectamine2000 (Invitrogen) according to manufacturer's instructions. Transfected was also varying concentrations of LNA-antimiRs. After 24 hours, cells were harvested for luciferase measurements.

Luciferase assay: The cells were washed with PBS and 100 µl 1× Passive Lysis Buffer (Promega) was added to each well, after which the 24-well plates was put on an orbital shaker for 30 min. The cells were collected and transferred to an eppendorf tube and spinned at 10.000 rpm for 30 min after which 10 µl were transferred to a 96-well plate and luciferase measurements were performed according to manufacturer's instructions (Promega).

Example 11

Length Assessment of Fully LNA-Substituted LNA-AntimiRs Antagonizing miR-21

Figure 10:
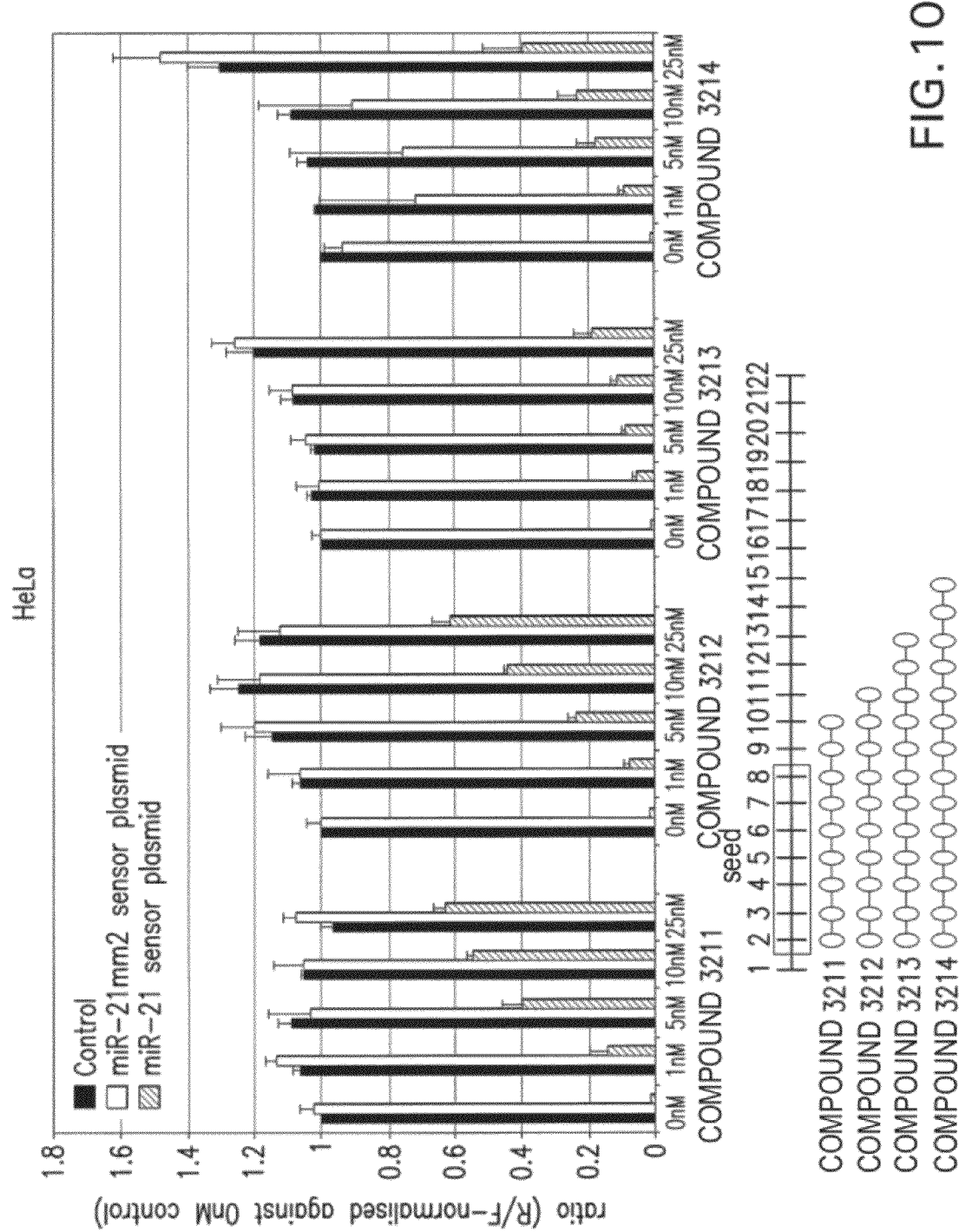
FIG. 10. Length assessment of fully LNA-substituted LNA-antimiRs antagonizing miR-21. HeLa cells were co-transfected with luciferase reporter plasmids containing a perfect match or a mismatch target site for miR-21 and LNA-antimiRs at different concentrations (Compound 3211=9-mer (SEQ ID NO: 9), Compound 3212=10-mer (SEQ ID NO: 10), Compound 3213=12-mer (SEQ ID NO: 11) and Compound 3214=14-mer (SEQ ID NO: 12)). After 24 hours, cells were harvested and luciferase activity measured. Shown are the mean values (bars=s.e.m) for three independent experiments where the *renilla*/firefly ratios have been normalized against 0 nM empty vector without target site (=control). Shown is also a schematic presentation of the miR-21 sequence and the design and position of the LNA-antimiRs.

Next, we investigated the effect of increasing the length from a 9-mer to a 14-mer fully LNA substituted LNA-antimiRs on antagonizing miR-21 in HeLa cells. The resulting LNA-antimiRs were transfected into HeLa cells together with the miR-21 luciferase reporter constructs (FIG. 10). Luciferase measurements were performed after 24 hours.

Results: The 9-mer LNA-antimiR Compound 3211 (SEQ ID NO: 9) (9-mer) showed dose-dependent de-repression of the miR-21 luciferase reporter which did not reach complete de-repression, as demonstrated for the 7-mer LNA-antimiR (Compound 3210, SEQ ID NO: 8). Increasing the length to 10-mer to 14-mer (Compound 3212, (SEQ ID NO: 10); Compound 3213 (SEQ ID NO: 11); and Compound 3214 (SEQ ID NO: 12)) decreased the potency as shown by less efficient de-repression of the miR-21 reporter.

Conclusion: As shown in FIG. 10, the longest fully LNA-modified and phosphorothiolated LNA-antimiR which is still able to mediate miR-21 inhibition is a 9-mer LNA-antimiR Compound 3211 (SEQ ID NO: 9). However, it is clearly less efficient than the 7-mer and 8-mer LNA-antimiRs.

Materials and Methods: Cell line: The human cervix carcinoma cell line HeLa was purchased from ECACC (#93021013). HeLa cells were cultured in EMEM medium, supplemented with 10% fetal bovine serum, 2 mM Glutamax, 1×NEAA and 25 ug/ml Gentamicin.

Transfection: 60.000 cells were seeded per well in a 24-well plate the day before transfection in order to achieve 50-70% confluency the next day. On the day of transfection, HeLa cells were transfected with 0.2 ug miR-21 perfect match/psiCHECK2, miR-21.mm2/psiCHECK2 or empty psiCHECK2 control vector without target site together with 0.7 µl Lipofectamine2000 (Invitrogen) according to manufacturer's instructions. Transfected was also varying concentrations of LNA-antimiRs. After 24 hours, cells were harvested for luciferase measurements.

Luciferase assay: The cells were washed with PBS and 100 µl 1× Passive Lysis Buffer (Promega) was added to each well, after which the 24-well plates were put on an orbital shaker for 30 min. The cells were collected and transferred to an eppendorf tube and spinned at 10.000 rpm for 30 min after which 10 µl were transferred to a 96-well plate and luciferase measurements were performed according to manufacturer's instructions (Promega).

Example 12

Figure 11:
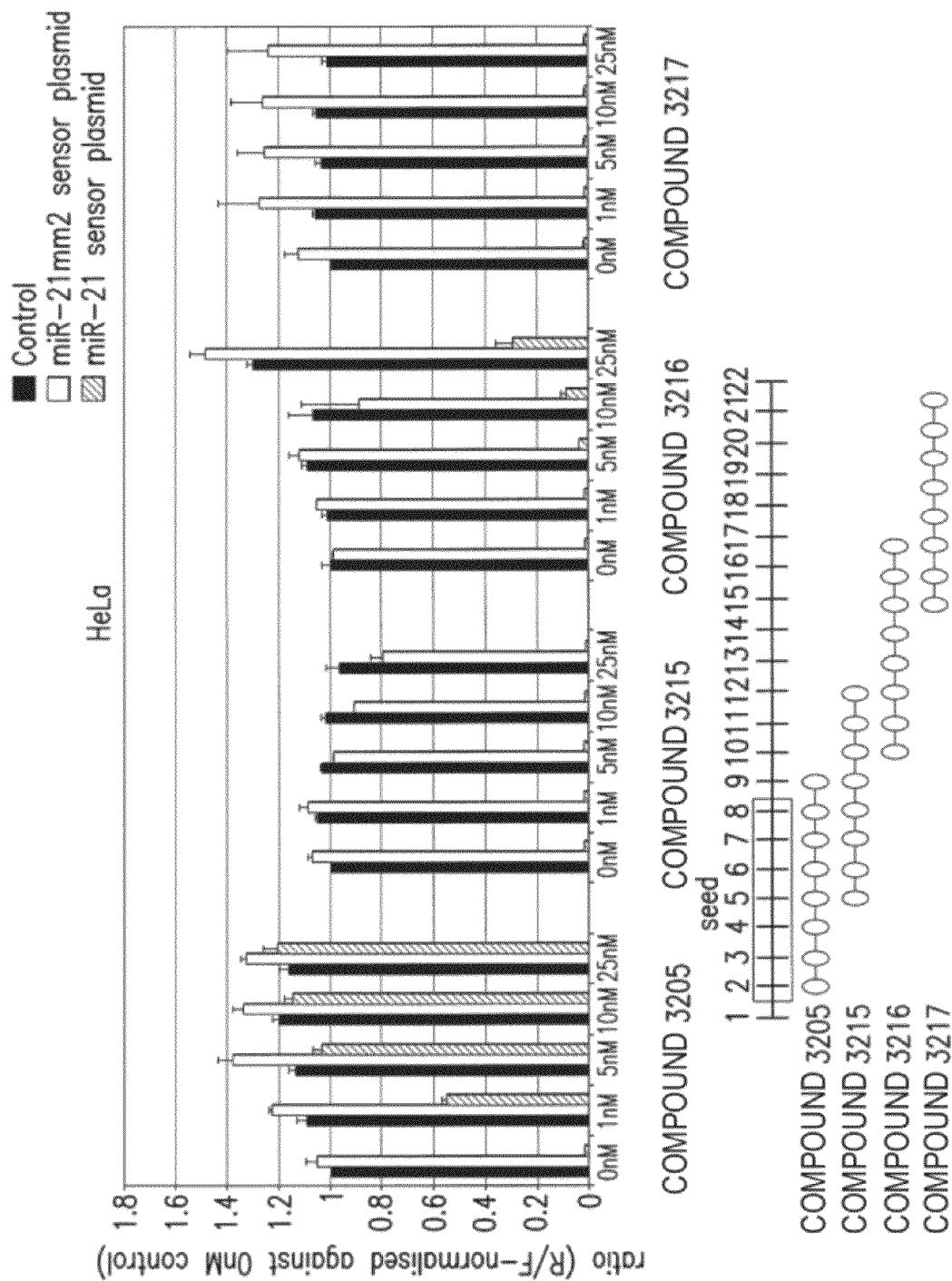
FIG. 11. Determination of the most optimal position for an 8-mer LNA-antimiR within the miR target recognition sequence. HeLa cells were co-transfected with luciferase reporter plasmids containing a perfect match or a mismatch target site for miR-21 and the LNA-antimiRs at different concentrations. After 24 hours, cells were harvested and luciferase activity measured. Shown are the mean values (bars=s.e.m) for three independent experiments where the *renilla*/firefly ratios have been normalized against 0 nM empty vector without target site (=control). Shown is also a schematic presentation of the miR-21 sequence and the design and position of the LNA-antimiRs (Compound 3205 (SEQ ID NO: 2; Compound 3215 (SEQ ID NO: 13); Compound 3216 (SEQ ID NO: 14); Compound 3217 (SEQ ID NO: 15).

Determination of the Most Optimal Position for an 8-mer LNA-AntimiR within the miR Target Recognition Sequence Our experiments have shown that the most potent fully LNA-modified phosphorothiolated LNA-antimiR is 8 nucleotides in length. To assess the most optimal position for an 8-mer LNA-antimiR within the miR target recognition sequence, we designed four different fully LNA-modified 8-mer LNA-antimiRs tiled across the mature miR-21 sequence as shown in FIG. 11. The different LNA-antimiRs were co-transfected together with the miR-21 luciferase reporter constructs into HeLa cells. Luciferase measurements were performed after 24 hours.

Results: The only LNA-antimiR that mediated efficient silencing of miR-21 as measured by the luciferase reporter was Compound 3205 (SEQ ID NO: 2), which targets the seed region of miR-21. Neither Compound 3215 (SEQ ID NO: 13) which was designed to cover the 3' end of the seed (50% seed targeting) did not show any effect, nor did the other two LNA-antimiRs Compound 3216 (SEQ ID NO: 14) or Compound 3217 (SEQ ID NO: 15), which were positioned to target the central region and the 3"end of the mature miR-21, respectively.

Conclusion: The only 8-mer LNA-antimiR mediating potent silencing of miR-21 is the one targeting the seed of the miR-21.

Materials and Methods:

Cell line: The human cervix carcinoma cell line HeLa was purchased from ECACC (#93021013). HeLa cells were cultured in EMEM medium, supplemented with 10% fetal bovine serum, 2 mM Glutamax, 1×NEAA and 25 ug/ml Gentamicin.

Transfection: 60.000 cells were seeded per well in a 24-well plate the day before transfection in order to achieve 50-70% confluency the next day. On the day of transfection, HeLa cells were transfected with 0.2 ug miR-21 perfect match/psiCHECK2, miR-21.mm2/psiCHECK2 or empty psiCHECK2 vector together with 0.7 µl Lipofectamine2000 (Invitrogen) according to the manufacturer's instructions. Transfected was also varying concentrations of LNA-antimiRs. After 24 hours, cells were harvested for luciferase measurements.

Luciferase assay: The cells were washed with PBS and 100 µl 1× Passive Lysis Buffer (Promega) was added to each well, after which the 24-well plates was put on an orbital shaker for 30 min. The cells were collected and transferred to an eppendorf tube and spinned at 10.000 rpm for 30 min after which 10 µl were transferred to a 96 well plate and luciferase measurements were performed according to manufacturer's instructions (Promega).

Example 13

Validation of Interaction of the miR-21 Target Site in the Pdcd-4-3'-UTR and miR-21 Using the 8-mer Compound 3205 (SEQ ID NO: 2) LNA-AntimiR.

The tumour suppressor protein Pdcd4 inhibits TPA-induced neoplastic transformation, tumour promotion and progression. Pdcd4 has also been shown to be upregulated in apoptosis in response to different inducers. Furthermore, downregulation of Pdcd4 in lung and colorectal cancer has also been associated with a poor patient prognosis. Recently, Asangani et al and Frankel et al showed that the Pdcd-4-3'-UTR contains a conserved target site for miR-21, and transfecting cells with an antimiR-21, resulted in an increase in Pdcd4 protein. We therefore constructed a luciferase reporter plasmid, harboring 313 nt of the 3'UTR region of Pdcd4 encompassing the aforementioned miR-21 target site, which was co-transfected together with different LNA-antimiRs into HeLa cells. The different LNA-antimiRs were; Compound 3205 (SEQ ID NO:2) (8-mer, perfect match) or Compound 3218 (SEQ ID NO: 16) (8-mer, mismatch). Luciferase measurements were performed after 24 hours.

Figure 12:
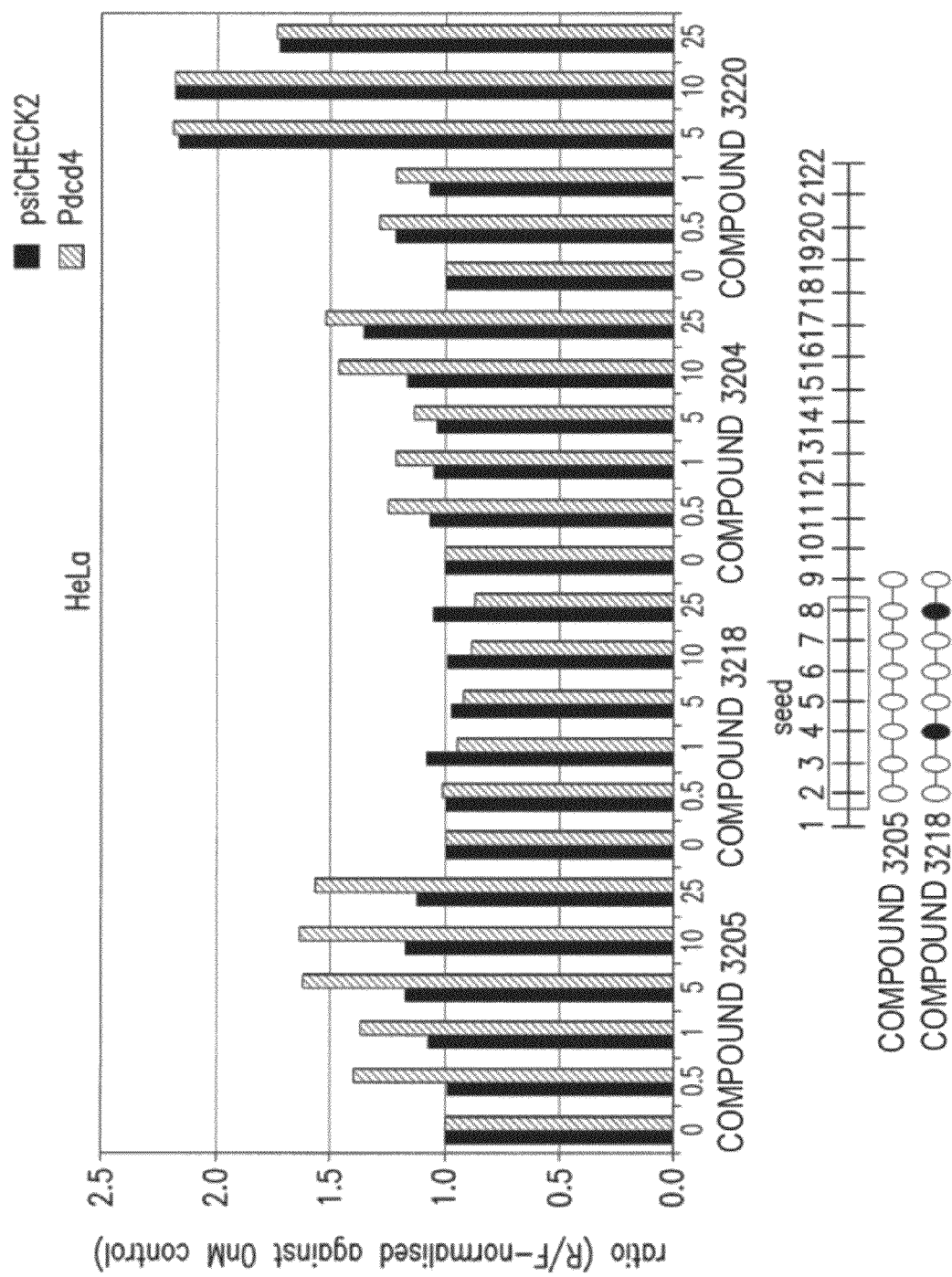
FIG. 12. Validation of interaction of the Pdcd-4-3'-UTR and miR-21 by the 8-mer Compound 3205 (SEQ ID NO: 2) LNA-antimiR. HeLa cells were co-transfected with a luciferase reporter plasmid containing part of the 3'UTR of Pdcd4 gene and LNA-antimiRs at different concentrations (Compound 3205=8-mer, perfect match (SEQ ID NO: 2); Compound 3218=8-mer, mismatch (SEQ ID NO: 16); Compound 3204=15-mer, LNA/DNA mix (SEQ ID NO: 1); Compound 3220=15-mer, gapmer (SEQ ID NO: 18)). After 24 hours, cells were harvested and luciferase activity measured. Shown are *renilla*/firefly ratios that have been normalized against 0 nM. Shown is also a schematic presentation of the miR-21 sequence and the design and position of the LNA-antimiRs.

Results: As shown in FIG. 12, in cells transfected with the Pdcd4 3'UTR luciferase reporter and Compound 3205 (SEQ ID NO: 2), an increase in luciferase activity was observed, indicating interaction between the Pdcd4 3'UTR and miR-21. However, transfecting the cells with the mismatch compound, Compound 3218 (SEQ ID NO: 16), no change in luciferase activity was observed, which was expected since the compound does not antagonize miR-21. When comparing the 8-mer LNA-antimiR against two longer designed LNA-antimiRs, the short fully LNA-modified and phosphorothiolated LNA-antimiR was significantly more potent, confirming previous luciferase assay data.

Conclusion: These data conclude that Compound 3205 (SEQ ID NO: 2), which antagonizes miR-21, can regulate the interaction between Pdcd4 3'UTR and miR-21.

Materials and Methods:

Cell line: The human cervix carcinoma cell line HeLa was purchased from ECACC (#93021013). HeLa cells were cultured in EMEM medium, supplemented with 10% fetal bovine serum, 2 mM Glutamax, 1×NEAA and 25 ug/ml Gentamicin.

Transfection: 60.000 cells were seeded per well in a 24-well plate the day before transfection in order to achieve 50-70% confluency the next day. On the day of transfection, HeLa cells were transfected with 0.2 ug Pdcd-4-3'UTR/psiCHECK2 or empty psiCHECK2 vector together with 0.7 Lipofectamine2000 (Invitrogen) according to the manufacturer's instructions. Varying concentrations of the LNA-antimiR oligonucleotides were also transfected. After 24 hours, cells were harvested for luciferase measurements.

Luciferase assay: The cells were washed with PBS and 100 µl 1× Passive Lysis Buffer (Promega) was added to each well, after which the 24-well plates was put on an orbital shaker for 30 min. The cells were collected and transferred to an eppendorf tube and spinned at 10.000 rpm for 30 min after which 10 µl were transferred to a 96 well plate and luciferase measurements were performed according to manufacturer's instructions (Promega).

Example 14

Comparison of an 8-mer LNA-AntimiR (Compound 3207, SEQ ID NO: 4) with a 15-mer LNA-AntimiR (Compound 3206, SEQ ID NO: 3) in Antagonizing miR-155 in Mouse RAW Cells To ask whether our approach of using short LNA-antimiRs could be adapted to targeting other miRNAs we designed a fully LNA-modified 8-mer LNA-antimiR against microRNA-155. A perfect match target site for miR-155 was cloned into the 3'UTR of the luciferase gene in the reporter plasmid psiCHECK2 and transfected into the mouse RAW macrophage cell line together with an 8-mer or a 15-mer LNA-antimiR. Because the endogenous levels of miR-155 are low in the RAW cell line, the cells were treated with 100 ng/ml LPS for 24 hours in order to induce miR-155 accumulation. After 24 hours, luciferase analysis was performed.

Figure 13:
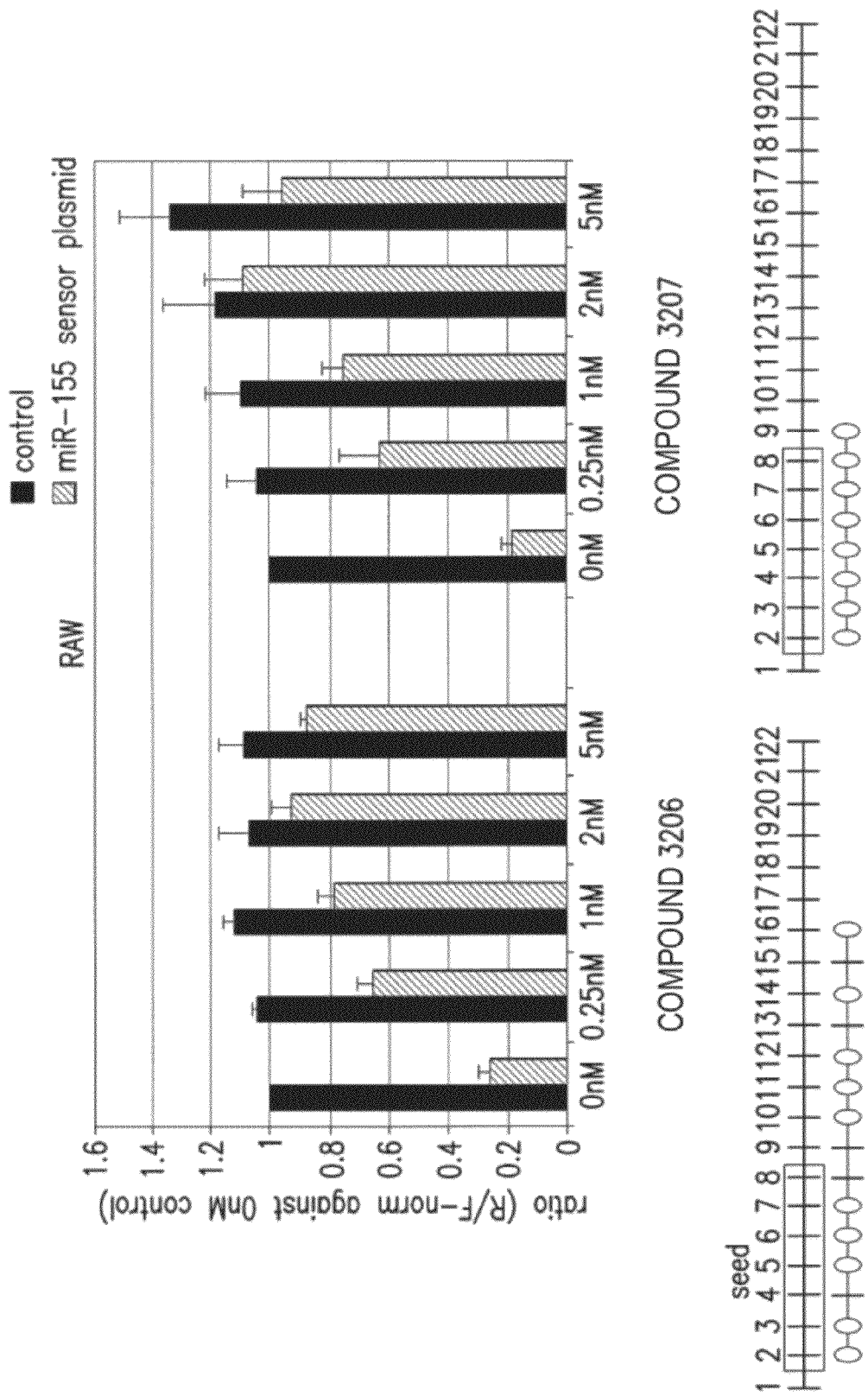
FIG. 13. Comparison of an 8-mer LNA-antimiR (Compound 3207 (SEQ ID NO: 4)) with a 15-mer LNA-antimiR (Compound 3206 (SEQ ID NO: 3)) in antagonizing miR-155 in mouse RAW cells. Mouse RAW cells were co-transfected with luciferase reporter plasmids containing a perfect match for miR-155 and the different LNA-antimiRs at different concentrations. After 24 hours, cells were harvested and luciferase activity measured. Shown are the mean values (bars=s.e.m) of three independent experiments where the *renilla*/firefly ratios have been normalized against 0 nM empty vector without miR-155 target site (=control). Shown is also a schematic presentation of the miR-155 sequence and the design and position of the LNA-antimiRs.

Results: Luciferase measurements showed that the fully LNA-modified 8-mer LNA-antimiR Compound 3207 (SEQ ID NO: 4) targeting miR-155 was similarly effective in antagonizing miR-155 compared to the 15-mer LNA-antimiR Compound 3206 (SEQ ID NO: 3) (FIG. 13). Both LNA-antimiRs showed a >50% de-repression of the miR-155 luciferase sensor at 0.25 nM concentration and inhibited miR-155 in a dose-dependent manner.

Analysis of the miRBase microRNA sequence database showed that the miR-155 recognition sequence, of the LNA-antimiR Compound 3207 (SEQ ID NO: 4) is unique for microRNA-155. However, when decreasing the LNA-antimiR length to 7 nt, it is not specific for only miR-155, mdv1-miR-M4 and kshv-miR-K12-11 (SEQ ID NO: 963) is also targeted.

Conclusion: A fully LNA-modified and phosphorothiolated 8-mer LNA-antimiR is equally potent compared with a 15-mer LNA-antimiR of a mixed LNA/DNA design in antagonizing miR-155. Thus, our approach of using short LNA-antimiRs can be readily adapted to targeting of other miRNAs Materials and Methods:

Cell line: The mouse macrophage RAW 264.7 cell line was purchased from ATCC (TIB-71). RAW cells were cultured in DMEM medium, supplemented with 10% fetal bovine serum, 4 mM Glutamax and 25 ug/ml Gentamicin.

Transfection: 500.000 cells were seeded per well in a 6-well plate the day before transfection in order to receive 50% confluency the next day. On the day of transfection, RAW 264.7 cells were transfected with 0.3 ug miR-155 perfect match/psiCHECK2 or empty psiCHECK2 vector together with 10 µl Lipofectamine2000 (Invitrogen) according to the manufacturer's instructions. Transfected was also varying concentrations of LNA-antimiRs. In order to induce miR-155 accumulation, LPS (100 ng/ml) was added to the RAW cells after the 4 hour incubation with the transfection complexes. After another 24 hours, cells were harvested for luciferase measurements.

Luciferase assay: The cells were washed with PBS and harvested with cell scraper, after which cells were spinned for 5 min at 2.500 rpm. The supernatant was discarded and 50 ml 1× Passive Lysis Buffer (Promega) was added to the cell pellet, after which cells were put on ice for 30 min. The lysed cells were spinned at 10.000 rpm for 30 min after which 20 µl were transferred to a 96-well plate and luciferase measurements were performed according to the manufacturer's instructions (Promega).

Example 15

Assessment of c/EBPβ Protein Levels as a Functional Readout for miR-155 Antagonism by Short LNA-AntimiR (Compound 3207, SEQ ID NO: 4).

As a functional readout for miR-155 antagonism by short LNA-antimiR (Compound 3207, SEQ ID NO: 4) we determined the protein levels of a novel miR-155 target, c/EBPβ. The mouse macrophage RAW cell line was transfected together with either an 8-mer (Compound 3207, SEQ ID NO: 4) or a 15-mer (Compound 3206 (SEQ ID NO: 3) LNA-antimiR in the absence or presence of pre-miR-155. As mismatch controls for the 15-mer, Compound 4 (SEQ ID NO: 5) was used, which targets miR-122 and for the 8-mer Compound 3205 (SEQ ID NO: 2) was used, which targets miR-21. These two control miRNAs do not regulate c/EBPβ expression levels. LPS was used to induce miR-155 accumulation and cells were harvested after 16 hours with LPS. c/EBPβ has three isoforms; LIP, LAP and LAP* that were detected by Western blot analysis and the same membranes were re-probed with beta-tubulin as loading control.

Figure 14:
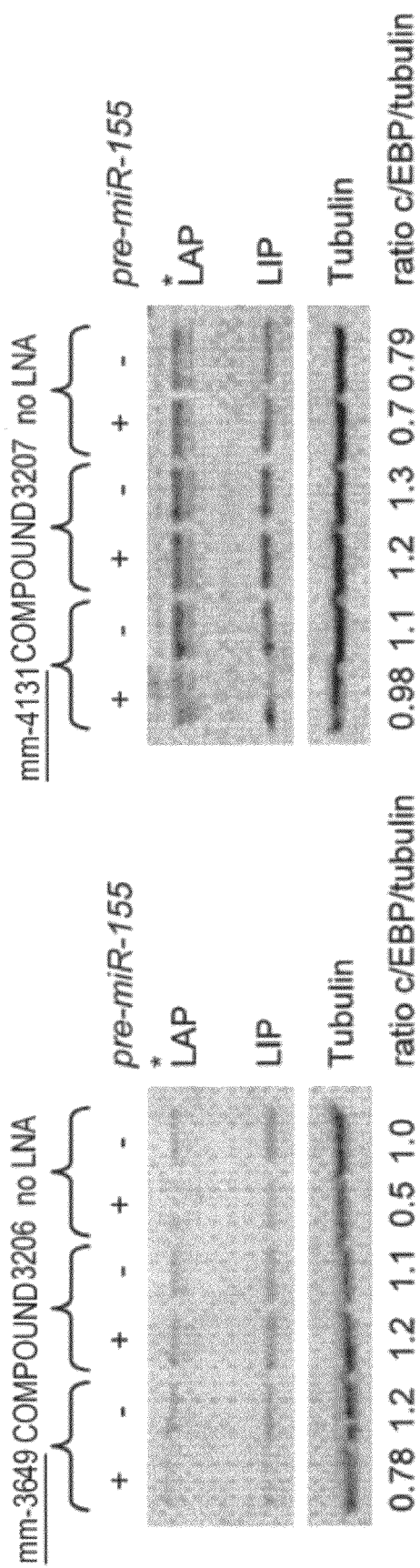
FIG. 14. Assessment of c/EBP□Assessment of c/EBPer LNA-antimiR (Compound 3207 (SEQ ID NO: 4)) with a 15-mer LNA-antimiR (Compound 3206 (SEQ ID NO: 3)) in antagonizing miR-155 in mouse RAW cells. Mouse RAW cells were co-transfected with luciferase reporter plasmids containing a perfect match for miR-155 and the diffter 20 hours, cells were harvested and western blot analysis of protein extracts from RAW cells was performed. The different isoforms of c/EBPβ are indicated, and the ratios calculated on c/EBPβ LIP and beta-tubulin are shown below.

Results: Ratios were calculated for c/EBPβ LIP and beta-tubulin as indicated in FIG. 14. RAW cells that were transfected with the 15-mer LNA-antimiR and no pre-miR-155 all showed equal c/EBPβ LIP/beta-tubulin ratios, due to inhibition of miR-155 increases the c/EBPβ LIP levels (FIG. 14, left panel). By comparison, transfection of pre-miR-155 in RAW cells resulted in decreased c/EBPβ LIP levels as expected, if c/EBPβ was a miR-155 target, as shown in lanes with protein extracts from RAW cells treated with no LNA or a mismatch. However, protein extracts from RAW cells transfected with LNA-antimiR against miR-155, showed an increase of c/EBPβ LIP levels. The same experiments were also carried out with the 8-mer LNA-antimiR-155 (Compound 3207, SEQ ID NO: 4) and as shown in FIG. 14 (right panel) comparable results to those with the 15-mer LNA-antimiR Compound 3206 (SEQ ID NO: 3) were obtained.

Conclusion: Antagonism of miR-155 using either an 8-mer or a 15-mer LNA-antimiR leads to de-repression of the direct target c/EBPβ.

Materials and Methods:

Cell line: The mouse macrophage RAW 264.7 cell line was purchased from ATCC (TIB-71). RAW cells were cultured in DMEM medium, supplemented with 10% fetal bovine serum, 4 mM Glutamax and 25 ug/ml Gentamicin.

Transfection: 500.000 cells were seeded per well in a 6-well plate the day before transfection in order to achieve 50% confluency the next day. On the day of transfection, RAW 264.7 cells were transfected with 5 nmol pre-miR-155 (Ambion) and/or 5 nM LNA-antimiR together with 10 µl Lipofectamine2000 (Invitrogen) according to the manufacturer's instructions. Transfected was also varying concentrations of LNA-antimiRs. In order to induce miR-155 accumulation, LPS (100 ng/ml) was added to the RAW cells after the 4 hour incubation with the transfection complexes. After 16 hours, cells were harvested for protein extraction and western blot analysis.

Western blot: Cells were washed with PBS, trypsinated, transferred to eppendorf tubes and 250 µl lysis buffer (1×RIPA) was added. The cell lysate was placed on ice for 20 min and spinned at 10.000 rpm for 10 minutes. The protein concentration was measured with Coomassie Plus according to the manufacturer's instructions and 80 ug was loaded onto a 4-12% BIS-TRIS gel. The membrane was incubated overnight at 4° C. with the primary monoclonal mouse antibody C/EBPβ (Santa Cruz) with a 1:100 concentration. Immunoreactive bands were visualized with ECL Plus (Amersham).

Example 16

Antagonism of miR-106b by a Fully LNA-Modified 8-mer (Compound 3221, SEQ ID NO: 19) LNA-AntimiR To confirm that our approach of using short LNA-antimiRs could be adapted to targeting of other miRNAs we designed a fully LNA-modified 8-mer LNA-antimiR against microRNA-106b. A perfect match target site for miR-106b was cloned into the 3'UTR of the luciferase gene in the vector (psiCHECK2) and transfected into the human cervix carcinoma HeLa cell line together with a short LNA-antimiR (Compound 3221, SEQ ID NO: 19) or with a 15-mer LNAantimiR (Compound 3228, SEQ ID NO: 26) at varying concentrations. Luciferase measurements were performed after 24 hours.

Figure 15:
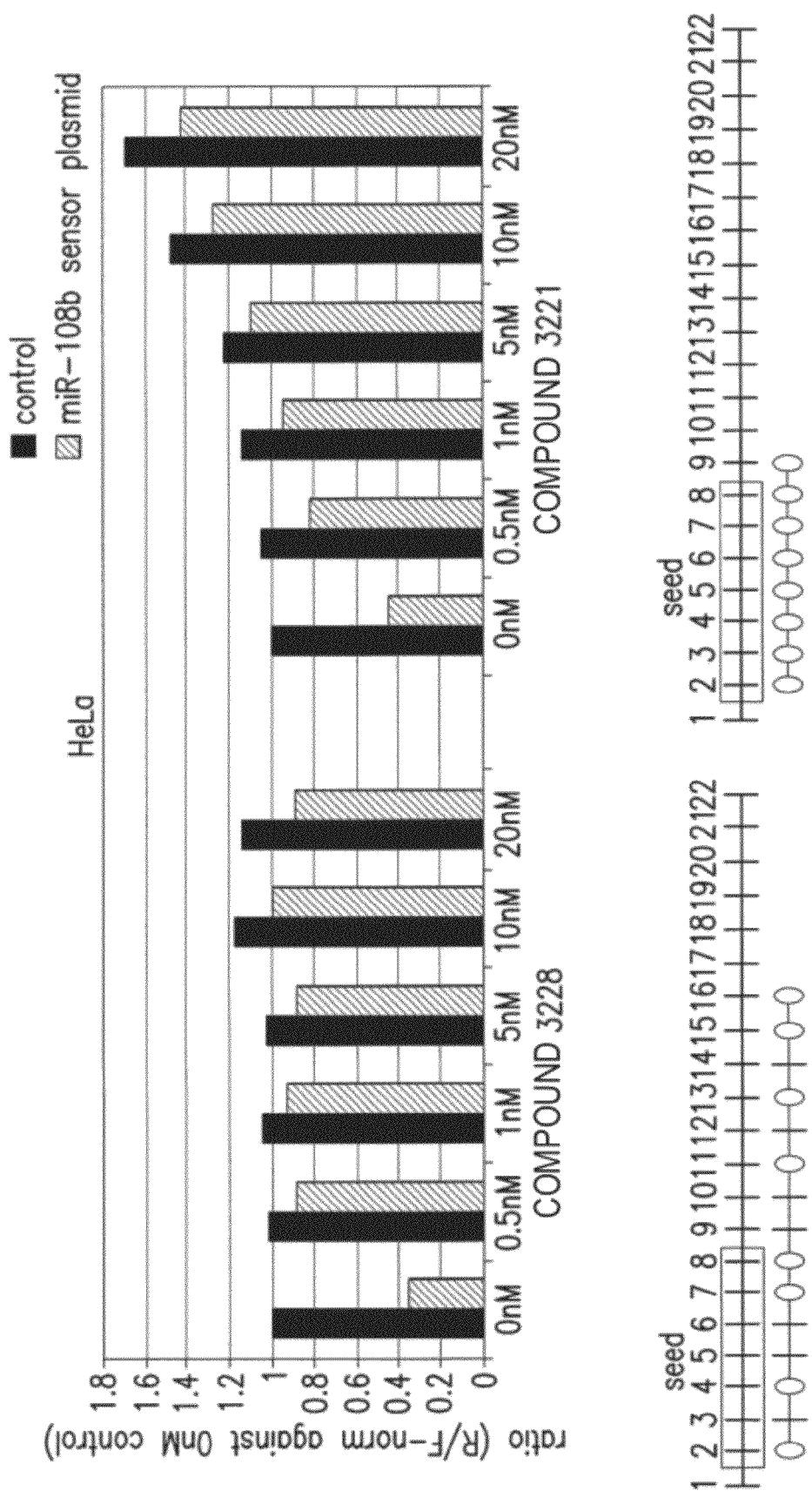
FIG. 15. Antagonism of miR-106b by a fully LNA-modified 8-mer (Compound 3221 (SEQ ID NO: 19)) LNA-antimiR or by a 15-mer mixmer (Compound 3228 (SEQ ID NO: 26)) antimiR. HeLa cells were co-transfected with luciferase reporter plasmids containing a perfect match for miR-106b and the different LNA-antimiRs at different concentrations. After 24 hours, cells were harvested and luciferase activity measured. Shown are the mean values of four replicates where the *renilla*/firefly ratios have been normalized against 0 nM empty vector without miRNA target site (=control). Shown is also a schematic presentation of the miR-106b sequence and the design and position of the LNA-antimiRs.

Results: Transfection of the 8-mer LNA-antimiR Compound 3221 (SEQ ID NO: 19) against miR-106b resulted in dose-dependent inhibition of miR-106b as shown by de-repression of the luciferase reporter, which was completely de-repressed at 1 nM LNA-antimiR concentration (FIG. 15). Comparable results were obtained using the 15-mer LNA-antimiR Compound 3228 (SEQ ID NO: 26) demonstrating that an 8-mer LNA-antimiR is similarly potent to a 15-mer.

Conclusion: Targeting of miR-106b in HeLa cells shows that an 8-mer fully LNA-modified and phosphorotiolated LNA-antimiR is equally potent compared with a 15-mer LNA/DNA mixmer LNA-antimiR.

Materials and Methods:

Cell line: The human cervix carcinoma cell line HeLa was purchased from ECACC (#93021013). HeLa cells were cultured in EMEM medium, supplemented with 10% fetal bovine serum, 2 mM Glutamax, 1×NEAA and 25 ug/ml Gentamicin.

Transfection: 5.200 cells were seeded per well in a 96-well plate the day before transfection in order to achieve 50-70% confluency the next day. On the day of transfection, HeLa cells were transfected with 57 ng miR-21 perfect match/psiCHECK2, miR-21.mm2/psiCHECK2 or empty psiCHECK2 vector together with 0.14 µl Lipofectamine2000 (Invitrogen) according to the manufacturer's instructions. Transfected was also varying concentrations of LNA-antimiRs. After 24 hours, cells were harvested for luciferase measurements.

Luciferase assay: The cells were washed with PBS and 30 µl 1× Passive Lysis Buffer (Promega) was added to each well, after which the 24-well plates was put on an orbital shaker for 30 min. The cells were collected and transferred to eppendorf tubes and spinned at 10.000 rpm for 30 min after which luciferase measurements were performed according to the manufacturer's instructions (Promega).

Example 17

Antagonism of miR-19a by a Fully LNA-Modified 8-Mer (Compound 3222, SEQ ID NO: 20) LNA-AntimiR To further confirm that our approach of using short LNA-antimiRs can be readily adapted to targeting of other miRNAs we designed a fully LNA-modified 8-mer LNA-antimiR against microRNA-19a. A perfect match target site for miR-19a was cloned in the 3'UTR of the luciferase gene in the psiCHECK2 vector. The reporter plasmid was transfected into the human cervix carcinoma HeLa cell line together with a short LNA-antimiR (Compound 3222, SEQ ID NO: 20) or with a 15-mer LNA-antimiR (Compound 3229, SEQ ID NO: 27) targeting miR-19a at varying concentrations. Luciferase measurements were performed after 24 hours.

Figure 16:
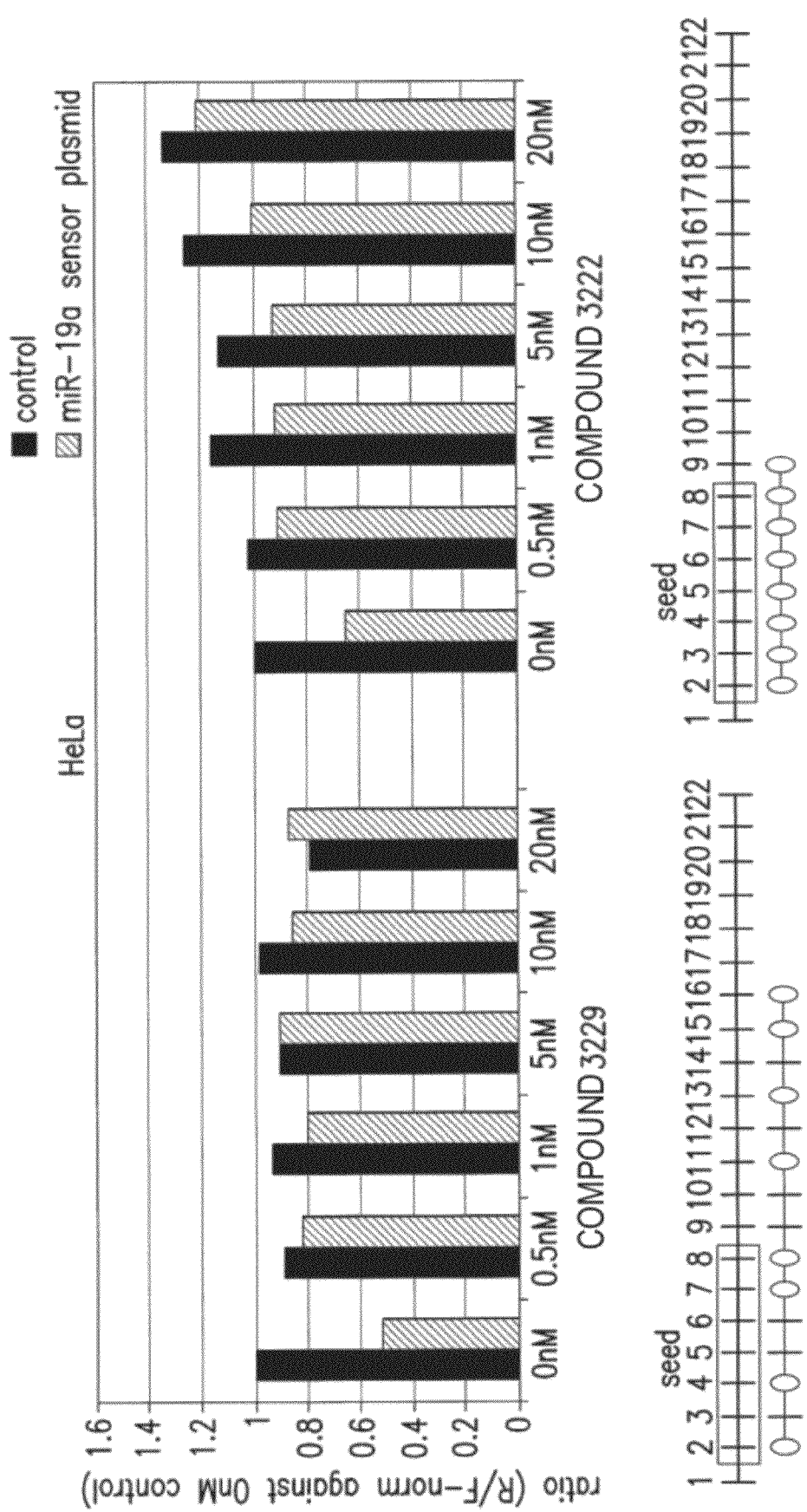
FIG. 16. Antagonism of miR-19b by a fully LNA-modified 8-mer (Compound 3222 (SEQ ID NO: 20)) LNA-antimiR and a 15-mer (Compound 3229 (SEQ ID NO: 27)) mixmer antimiR. HeLa cells were co-transfected with luciferase reporter plasmids containing a perfect match for miR-19a and the two LNA-antimiRs at different concentrations. After 24 hours, cells were harvested and luciferase activity measured. Shown are the mean values of four replicate experiments, where the *renilla*/firefly ratios have been normalized against 0 nM empty vector without a miR-19a target site (=control). Shown is also a schematic presentation of the miR-19a sequence and the design and position of the LNA-antimiRs.

Results: As shown in FIG. 16, transfection of the 15-mer LNA-antimiR Compound 3229 (SEQ ID NO: 27) into HeLa efficiently antagonizes miR-19a as demonstrated by complete de-repression at 1 nM LNA-antimiR concentration. By comparison, transfection of the 8-mer LNA-antimiR Compound 3222 (SEQ ID NO: 20) resulted in effective miR-19a antagonism already at 0.5 nM concentration, indicating that this 8-mer LNA-antimiR is at least equally potent compared with a 15-mer LNA-antimiR in HeLa cells.

Conclusion: Targeting of miR-19a in HeLa cells shows that an 8-mer fully LNA-modified and phosphorothiolated LNA-antimiR is at least equally potent compared with a 15-mer LNA/DNA mixmer LNA-antimiR.

Materials and Methods: Cell line: The human cervix carcinoma cell line HeLa was purchased from ECACC (#93021013). HeLa cells were cultured in EMEM medium, supplemented with 10% fetal bovine serum, 2 mM Glutamax, 1×NEAA and 25 ug/ml Gentamicin.

Transfection: 5.200 cells were seeded per well in a 96-well plate the day before transfection in order to achieve 50-70% confluency the next day. On the day of transfection, HeLa cells were transfected with 57 ng miR-21 perfect match/psiCHECK2, miR-21.mm2/psiCHECK2 or empty psiCHECK2 vector together with 0.14 µl Lipofectamine2000 (Invitrogen) according to manufacturer's instructions. Transfected was also varying concentrations of LNA-antimiRs. After 24 hours, cells were harvested for luciferase measurements.

Luciferase assay: The cells were washed with PBS and 30 µl 1× Passive Lysis Buffer (Promega) was added to each well, after which the 24-well plates was put on an orbital shaker for 30 min. The cells were collected and transferred to eppendorf tubes and spinned at 10.000 rpm for 30 min after which luciferase measurements were performed according to the manufacturer's instructions (Promega).

Example 18

Targeting of a MicroRNA Family Using Short, Fully LNA-Substituted LNA-AntimiR

Figure 17:
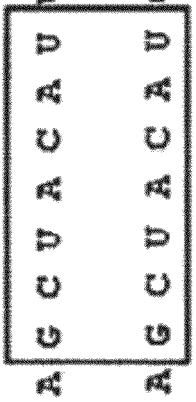
FIG. 17. Schematic presentation showing the mature human miR-221 (SEQ ID NO: 432) and miR-222 (SEQ ID NO: 434) sequences. Shown in the square is the seed sequence (7-mer) that is conserved in both miRNA sequences.

Next, we investigated whether it is possible to target a microRNA family using a single short 7-mer LNA-antimiR complementary to the seed sequence that is common for all family members (see FIG. 17). In this experiment, we focused on miR-221 and miR-222 that are overexpressed in solid tumors of the colon, pancreas, prostate and stomach. It has also been shown that miR-221 and miR-222 are the most significantly upregulated microRNAs in glioblastoma multiforme. Furthermore, overexpression of miR-221 and miR-222 may contribute to the growth and progression of prostate carcinoma, at least in part by blocking the tumor suppressor protein p27. A perfect match target site for both miR-221 and miR-222, respectively, was cloned into the 3'UTR of the luciferase gene resulting in two reporter constructs. These constructs were then transfected either separate or combined into the prostate carcinoma cell line, PC3. In addition to the 7-mer, targeting both miR-221 and miR-222, we also co-transfected a 15-mer LNA-antimiR (15mer) targeting either miR-221 (Compound 3223, SEQ ID NO: 21) or miR-222 (Compound 3224, SEQ ID NO: 22), each transfected separately or together (see FIG. 18 left).

Figure 18:
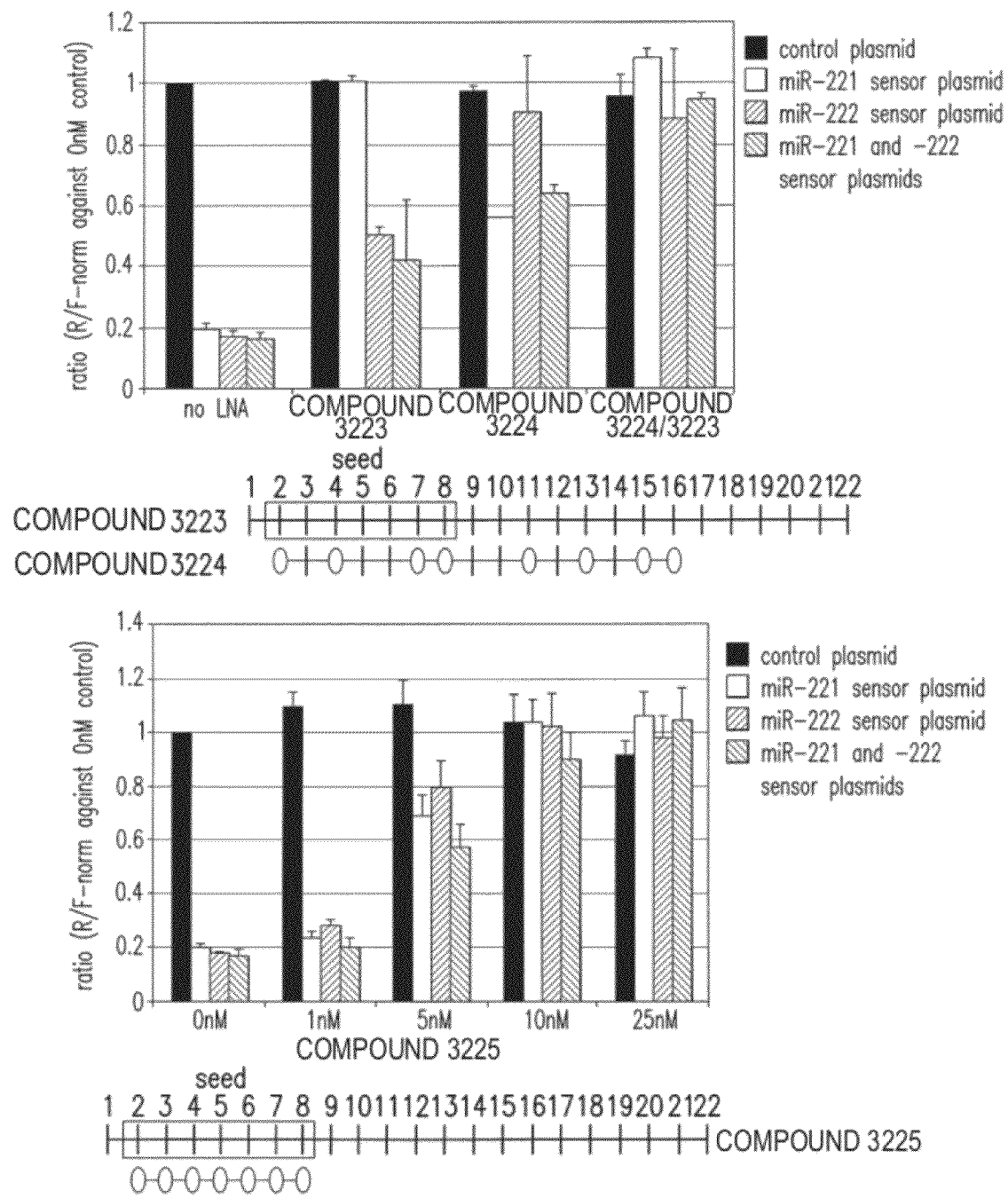
FIG. 18. Targeting of a microRNA family using short, fully LNA-substituted LNA-antimiR. PC3 cells were co-transfected with luciferase reporter plasmids for miR-221 and miR-222 separately or together and with the different LNA-antimiRs at varying concentrations. When co-transfecting with the LNA-antimiRs (15-mers) Compound 3223 (SEQ ID NO: 21) (against miR-221) and Compound 3224 (SEQ ID NO: 22) (against miR-222), the total concentration was 2 nM (1 nM each), while transfecting the cells with Compound 3225 (SEQ ID NO: 23) (7-mer) the concentrations were 0, 1, 5, 10 or 25 nM. After 24 hours, cells were harvested and luciferase activity measured. Shown are the mean values (bars=s.e.m) of three independent experiments where the *renilla*/firefly ratios have been normalized against 0 nM empty vector without a miRNA target site (=control). Shown is also a schematic presentation of the miR-221/222 sequence and the design and position of the LNA-antimiRs.

Results: As shown in FIG. 18, transfection of PC3 cells with the LNA-antimiR Compound 3223 (SEQ ID NO: 21) against miR-221 resulted in efficient inhibition of miR-221 at 1 nM LNA-antimiR concentration. An inhibitory effect is also observed when using the luciferase reporter plasmid for miR-222 as well as when co-transfecting both luciferase reporters for miR-221 and miR-222 simultaneously into PC3 cells. This inhibitory effect is most likely due to the shared seed sequence between miR-221 and miR-222. Similarly, transfection of PC3 cells with the LNA-antimiR Compound 3224 (SEQ ID NO: 22) against miR-222 resulted in efficient inhibition of miR-222 at 1 nM LNA-antimiR concentration as shown by complete de-repression of the luciferase reporter for miR-222. An inhibitory effect is also observed when using the luciferase reporter plasmid for miR-222 as well as when co-transfecting both luciferase reporters for miR-221 and miR-222 simultaneously into PC3 cells. Co-tranfection of both LNA-antimiR compounds Compound 3223 (SEQ ID NO: 21) and Compound 3224 (SEQ ID NO: 22) against miR-221 and miR-222, respectively, (see FIG. 18 left), resulted in effective inhibition of both miRNAs as shown by complete de-repression of the luciferase reporter plasmids both when separately transfected and when co-transfected into PC3 cells. Interestingly, transfection of a single fully LNA-modified 7-mer LNA-antimiR (Compound 3225, SEQ ID NO: 23) targeting the seed sequence of miR-221 and miR-222 into PC3 cells resulted in efficient, dose-dependent antagonism of miR-221 and miR-222 simultaneously as shown by complete de-repression of the luciferase reporter plasmids both when separately transfected and when co-transfected into PC3 cells. This demonstrates that a single, short LNA-substituted LNA-antimiR can effectively target seed sequences thereby antagonizing entire microRNA families simultaneously. Analysis of the miRBase microRNA sequence database showed that the miR-221/222 seed recognition sequence, of the LNA-antimiR Compound 3225 (SEQ ID NO: 23) is unique for both miRNAs.

Conclusion: Our results demonstrate that LNA enables design and synthesis of short fully LNA-substituted LNA-antimiR oligonucleotides that can effectively target microRNA seed sequences thereby antagonizing entire microRNA families simultaneously.

Materials and Methods:

Cell line: The human prostate carcinoma PC3 cell line was purchased from ECACC (#90112714) PC3 cells were cultured in DMEM medium, supplemented with 10% fetal bovine serum, 2 mM Glutamax and 25 ug/ml Gentamicin.

Transfection: 100.000 cells were seeded per well in a 12-well plate the day before transfection in order to receive 50% confluency the next day. On the day of transfection, PC3 cells were transfected with 0.3 ug of luciferase reporter plasmid for miR-221 or for miR-222 or with empty psiCHECK2 vector without miRNA target site as control together with 1.2 µl Lipofectamine2000 (Invitrogen) according to the manufacturer's instructions. After 24 hours, cells were harvested for luciferase measurements.

Luciferase assay: The cells were washed with PBS and 250 µl 1× Passive Lysis Buffer (Promega) was added to the wells. The plates were placed on a shaker for 30 min., after which the cell lysates was transferred to eppendorf tubes. The cell lysate was spinned for 10 min at 2.500 rpm after which 20 µl were transferred to a 96-well plate and luciferase measurements were performed according to the manufacturer's instructions (Promega).

Example 19

Assessment of P27 Protein Levels as a Functional Readout for Antagonism of the miR-221/222 Family by the 7-mer Compound 3225 (SEQ ID NO: 23) LNA-AntimiR.

Figure 19:
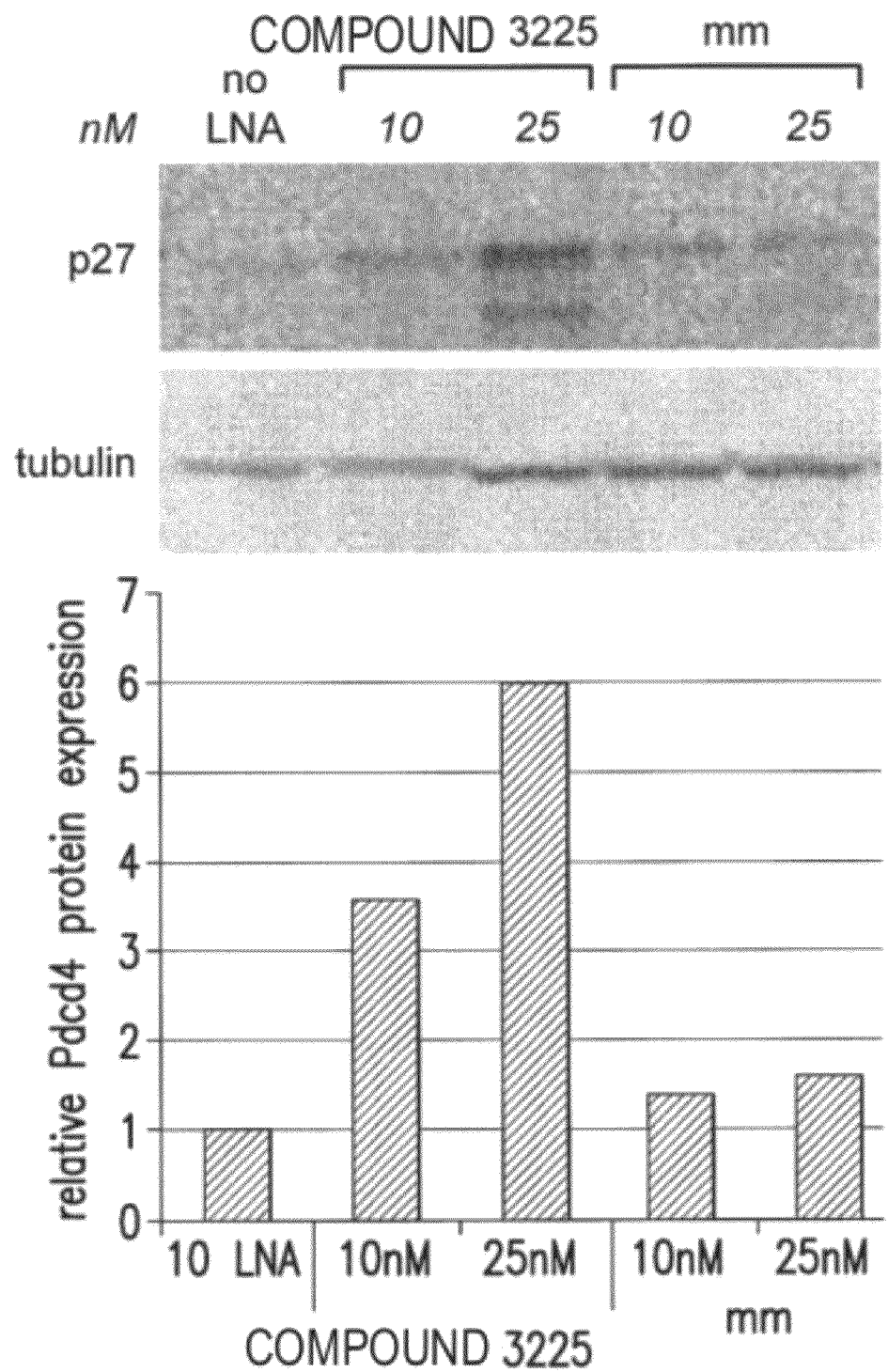
FIG. 19. Assessment of p27 protein levels as a functional readout for antagonism of the miR-221/222 family by the 7-mer Compound 3225 (SEQ ID NO: 23) LNA-antimiR. PC3 cells were transfected with the 7-mer LNA-antimiR Compound 3225 (SEQ ID NO: 23) targeting both miR-221 and miR-222 at varying concentrations. After 24 hours, cells were harvested and protein levels were measured on a western blot. Shown are the ratios of p27/tubulin.

Previous work has shown (le Sage et al. 2007, Galardi et al. 2007) that miR-221 and miR-222 post-transcriptionally regulate the expression of the tumour suppressor gene p27, which is involved in cell cycle regulation. In these studies, down-regulation of miR-221 and miR-222 was shown to increase expression levels of p27. Thus, as a functional readout for antagonism of the miR-221/222 family by the 7-mer Compound 3225 (SEQ ID NO: 23) LNA-antimiR we determined the protein levels of p27 after transfection of the LNA-antimiR Compound 3225 (SEQ ID NO: 23) into PC3 cells in comparison with an 8-mer LNA mismatch control. After 24 hours the cells were harvested for western blot analysis (FIG. 19).

Results: As shown in FIG. 19, transfection of the 7-mer LNA-antimiR Compound 3225 (SEQ ID NO: 23) targeting the seed sequence in miR-221 and miR-222 resulted in dose-dependent increase of the p27 protein levels compared to either untransfected or LNA mismatch control transfected PC3 cells. These results clearly demonstrate that the 7-mer LNA-antimiR is able to effectively antagonize the miR-221/222 family leading to de-repression of the direct target p27 at the protein level.

Conclusion: A fully LNA-modified 7-mer LNA-antimiR targeting the seed sequence in the miR-221/222 family effectively antagonized both miRNAs leading to de-repression of the direct target p27 at the protein level.

Materials and Methods:

Cell line: The human prostate carcinoma PC3 cell line was purchased from ECACC (#90112714) PC3 cells were cultured in DMEM medium, supplemented with 10% fetal bovine serum, 2 mM Glutamax and 25 ug/ml Gentamicin.

Transfection: 250.000 cells were seeded per well in a 6-well plate the day before transfection in order to receive 50% confluency the next day. On the day of transfection, PC3 cells were transfected with LNA-antimiRs at varying concentrations with Lipofectamine2000. Cells were harvested after 24 hours for protein extraction and western blot analysis.

Western blot: Cells were washed with PBS, trypsinated, transferred to eppendorf tubes and 250 ml lysis buffer (1×RIPA) was added. The cell lysate was placed on ice for 20 min, then spinned at 10.000 rpm for 10 minutes. The protein concentration was measured with Coomassie Plus according to the manufacturer's instructions and 100 ug was loaded onto a 4-12% BIS-TRIS gel. The membrane was incubated overnight at 4° C. with the primary monoclonal mouse antibody p27 (BD Biosciences) at a 1:1000 dilution. Immunoreactive bands were visualized with ECL Plus (Amersham).

Example 20

Duplex Melting Temperatures ($T_m$) of the LNA-AntimiRs

As shown in Table 5, $T_m$ values increase with increasing the length of short fully modified LNA-antimiRs (see $T_m$ values for Compound 3205 (SEQ ID NO: 2) and Compounds 3209 to 3214 (SEQ ID NOs: 7 to 12) in Table 7). Most optimal inhibitory effect was achieved with the 8-mer LNA-antimiR Compound 3205 (SEQ ID NO: 2) against miR-21, whereas the very low Tm of the 6-mer Compound 3209 (SEQ ID NO: 7) is most likely not sufficient to mediate antagonism of the miR-21 target. On the other hand, increasing the length beyond a 10-mer (Compound 3212, SEQ ID NO: 10) significantly increases the $T_m$, while simultaneously decreasing the inhibitory activity as measured using the luciferase miR-21 reporter, which is most likely due to high propensity of the fully modified 12- and 14-mer LNA-antimiRs to form homodimers. The experiments using a sliding window of fully LNA-modified 8-mer LNA-antimiRs across the mir-21 recognition sequence clearly demonstrate that in addition to adequate $T_m$ value of the LNA-antimiR, the seed region is most critical for miRNA function and, thus, the most optimal region to be targeted by an LNA-antimiR.

TABLE 5

T$_m$ values for miR-21 LNA-antimiRs, measured against a complementary RNA oligonucleotide

| Compound | SEQ ID NO: | microRNA | Length (bp) | Sequence | Measured T$_m$ (RNA) ° C. |
|---|---|---|---|---|---|
| 3205 | 2 | miR-21 | 8 | 5'- GATAAGCT -3' | 64.0 |
| 3209 | 7 | miR-21 | 6 | 5'- TAAGCT -3' | 32.0 |
| 3210 | 8 | miR-21 | 7 | 5'- ATAAGCT -3' | 45.0 |
| 3211 | 9 | miR-21 | 9 | 5'- TGATAAGCT -3' | 65.0 |
| 3212 | 10 | miR-21 | 10 | 5'- CTGATAAGCT -3' | 63.0 |
| 3213 | 11 | miR-21 | 12 | 5'- GTCTGATAAGCT -3' | 86.8 |
| 3214 | 12 | miR-21 | 14 | 5'- CAGTCTGATAAGCT -3' | 89.9 |
| 3215 | 13 | miR-21 | 8 | 5'- TCTGATAA -3' | 56.0 |
| 3216 | 14 | miR-21 | 8 | 5'- ATCAGTCT -3 | 72.0 |
| 3217 | 15 | miR-21 | 8 | 5'- TCAACATC -3 | 48.0 |

Conclusion: The T$_m$ values along with experimental data obtained with luciferase reporters show that potent antagonism by LNA-antimiR is not only dependent on T$_m$ but also depends on the positioning of the LNA-antimiR within the microRNA recognition sequence.

Materials and Methods:

T$_m$ measurements: The oligonucleotide:miR-21 RNA duplexes were diluted to 3 µM in 500 µl RNase free H$_2$O and mixed with 500 µl 2×T$_m$-buffer (200 mM NaCl, 0.2 mM EDTA, 20 mM Na-phosphate, pH 7.0). The solution was heated to 95° C. for 3 min and then allowed to anneal in RT for 30 min. The duplex melting temperatures (T$_m$) were measured on a Lambda 40 UV/VIS Spectrophotometer equipped with a Peltier temperature programmer PTP6 using PE Templab software (Perkin Elmer). The temperature was ramped up from 20° C. to 95° C. and then down to 25° C., recording absorption at 260 nm. First derivative and the local maximums of both the melting and annealing were used to assess the duplex melting temperatures.

Example 21

Assessment of miR-21 Antagonism by Comparing an 8-mer (Compound 3205, SEQ ID NO: 2) Versus a 15-mer (Compound 3204, SEQ ID NO: 1) LNA-AntimiR in Human Hepatocytic Cell Line HepG2

We have previously shown in this application, that an 8-mer LNA-antimiR that is fully LNA-modified and phosphorothiolated effectively antagonizes miR-21 in the human cervix carcinoma cell line HeLa, the human breast carcinoma cell line MCF-7 and the human prostate cancer cell line PC3. We extended this screening approach to the human hepatocellular cancer cell line HepG2. To assess the efficiency of the 8-mer LNA-antimiR oligonucleotide against miR-21, luciferase reporter constructs were generated in which a perfect match target site for the mature miR-21 was cloned into the 3'UTR of the *Renilla* luciferase gene. In order to monitor miR-21 inhibition, HepG2 cells were transfected with the luciferase constructs together with the miR-21 antagonist Compound 3205 (SEQ ID NO: 2) (8-mer) and for comparison of specificity with the 8-mer LNA-antimiR mismatch (Compound 3218, SEQ ID NO: 16) and for comparison of potency together with the 15-mer (Compound 3204, SEQ ID NO: 1) at varying concentrations. After 24 hours, luciferase activity was measured.

Figure 20:
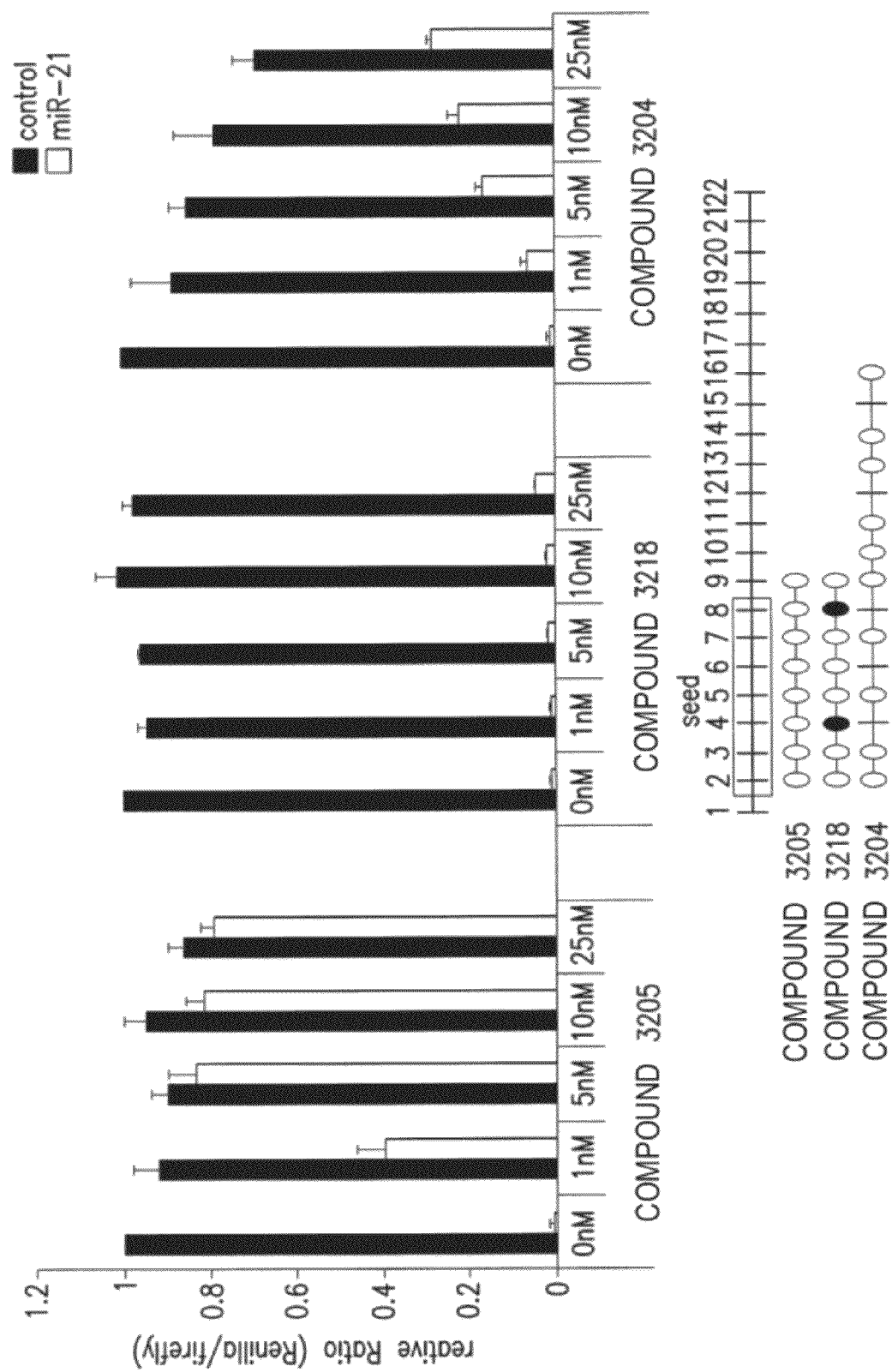
FIG. 20. Assessment of miR-21 antagonism by an 8-mer LNA-antimiR Compound 3205 (SEQ ID NO: 2) versus a 15-mer LNA-antimiR Compound 3204 (SEQ ID NO: 1) and an 8-mer with 2 mismatches Compound 3218 (SEQ ID NO: 16) in HepG2 cells using a luciferase reporter assay.

Results: The luciferase reporter experiments showed a dose-dependent de-repression of the luciferase miR-21 reporter activity with the 15-mer LNA-antimiR against miR-21 (Compound 3204, SEQ ID NO: 1). However, complete de-repression of the luciferase reporter was not obtained, not even at the higher concentrations (FIG. 20). In contrast, the cells that were transfected with the 8-mer fully LNA modified LNA-antimiR (Compound 3205, SEQ ID NO: 2) showed complete de-repression already at 5 nM, indicating significantly improved potency compared to the 15-mer LNA-antimiR. Comparing the specificity of the 8-mer perfect match and the 8-mer mismatch, the mismatch LNA-antimiR (Compound 3218, SEQ ID NO: 16) did not show any de-repression at all, demonstrating high specificity of the LNA-antimiR compound against miR-21.

Conclusion: The 8-mer (Compound 3205, SEQ ID NO: 2) is more potent than the 15-mer LNA-antimiR in targeting miR-21 and antagonism of miR-21 by Compound 3205 (SEQ ID NO: 2) is specific.

Materials and Methods:

Cell line: The human hepatocytic HepG2 cell line was purchased from ECACC (#85011430). HepG2 cells were cultured in EMEM medium, supplemented with 10% fetal bovine serum, 2 mM Glutamax and 25 ug/ml Gentamicin.

Transfection: 650.000 cells were seeded per well in a 6-well plate and reverse transfection were performed. HepG2 cells were transfected with 0.6 µg miR-21 or empty psiCHECK2 vector together with 2.55 µl Lipofectamine2000 (Invitrogen) according to manufacturer's instructions. Transfected was also varying concentrations of LNA-antimiRs. After 24 hours, cells were harvested for luciferase measurements.

Luciferase assay: The cells were washed with PBS and 300 µl 1× Passive Lysis Buffer (Promega) was added to the wells. The plates were placed on a shaker for 30 min., after which the cell lysates were transferred to eppendorf tubes. The cell lysate was centrifugated for 10 min at 2.500 rpm after which

Example 22

Validation of Interaction of the miR-21 Target Site in the Pdcd4 3'UTR and miR-21 Using the 8-mer Compound 3205 (SEQ ID NO: 2) LNA-AntimiR in Human Hepatocellular Cell Line Huh-7

The tumour suppressor protein Pdcd4 inhibits tumour promotion and progression. Furthermore, downregulation of Pdcd4 in lung and colorectal cancer has also been associated with poor patient prognosis. Recently, Asangani et al (Oncogene 2007) and Frankel et al (J Biol Chem 2008) showed that the Pdcd4 3'UTR contains a conserved target site for miR-21, and transfecting cells with an antimiR-21, resulted in an increase in Pdcd4 protein. We therefore constructed a luciferase reporter plasmid, harboring 313 nt of the 3'UTR region of Pdcd4 encompassing the aforementioned miR-21 target site, which was co-transfected together with different LNA-antimiRs and pre-miR-21 (10 nM) into Huh-7 cells. The different LNA-antimiRs were; Compound 3205 (SEQ ID NO: 2) (8-mer, perfect match), Compound 3218 (SEQ ID NO: 16) (8-mer, mismatch) and Compound 3204 (SEQ ID NO: 1) (15-mer, DNA/LNA mixmer). Luciferase measurements were performed after 24 hours.

Results: As shown in FIG. 21, cells transfected with the Pdcd4 3'UTR luciferase reporter and Compound 3205 (SEQ ID NO: 2), an increase in luciferase activity was observed, indicating interaction between the Pdcd4 3'UTR and miR-21. However, transfecting the cells with the mismatch compound, Compound 3218 (SEQ ID NO: 16), no change in luciferase activity was observed, which was expected since the compound does not antagonize miR-21. When comparing the 8-mer LNA-antimiR against the 15-mer LNA-antimiR (Compound 3204, SEQ ID NO: 1), the short fully LNA-modified and phosphorothiolated LNA-antimiR was significantly more potent, confirming previous data.

Materials and Methods:

Cell line: The human hepatoma cell line Huh-7 was a kind gift from R. Bartinschlager (Dept Mol Virology, University of Heidelberg). Huh-7 cells were cultured in DMEM medium, supplemented with 10% fetal bovine serum, 2 mM Glutamax, 1×NEAA and 25 ug/ml Gentamicin.

Transfection: 11.000 cells were seeded per well in a 96-well plate the day before transfection in order to achieve 50-70% confluency the next day. On the day of transfection, Huh-7 cells were transfected with 20 ng Pdcd4 3'UTR/psiCHECK2 or empty psiCHECK2 vector together with 10 nM pre-miR-21 (Ambion) and 0.14 µl Lipofectamine2000 (Invitrogen) according to the manufacturer's instructions. Varying concentrations of the LNA-antimiR oligonucleotides were also transfected. After 24 hours, cells were harvested for luciferase measurements.

Luciferase assay: Cells were washed and 30 µl 1× Passive Lysis Buffer (Promega) was added to each well, after which the 96-well plates was put on an orbital shaker. After 30 min., 50 µl luciferase substrate dissolved in Luciferase Assay Buffer II (Dual-Luciferase Reporter Assay System from Promega, Cat# E1910) was added to the wells with lysated cells and luciferase measurements were performed according to the manufacturer's instructions (Promega). 50 µl were transferred to a 96 well plate and luciferase measurements were performed according to the manufacturer's instructions (Promega).

Example 23

Assessment of Pdcd4 Protein Levels as a Functional Readout for miR-21 Antagonism by the 8-mer LNA-AntimiR (Compound 3205, SEQ ID NO: 2).

In addition, we also transfected HeLa cells with Compound 3205 (SEQ ID NO: 2) (perfect match), Compound 3218 (SEQ ID NO: 16) (mismatch), Compound 3219 (SEQ ID NO: 17) (scrambled) and analyzed Pdcd4 protein levels after 24 hours with Western blot (FIG. 22). As shown, in the protein extracts from cells where Compound 3205 (SEQ ID NO: 2) had been added, the Pdcd4 protein levels increase, due to antagonism of mir-21 by Compound 3205 (SEQ ID NO: 2) in contrast to the two control LNA oligonucleotides.

Conclusion: Antagonism of miR-21 using an 8-mer (Compound 3205, SEQ ID NO: 2) leads to derepression of the direct target Pdcd4 □ntagorism of miR-21

Materials and Methods:

Cell line: The human cervix carcinoma cell line HeLa was purchased from ECACC (#93021013). HeLa cells were cultured in EMEM medium, supplemented with 10% fetal bovine serum, 2 mM Glutamax, 1×NEAA and 25 ug/ml Gentamicin.

Transfection: 200.000 cells were seeded per well in a 6-well plate the day before transfection in order to receive 50-70% confluency the next day. On the day of transfection, HeLa cells were transfected with 5 nM LNA oligonucleotides and 2.5 µg/ml Lipofectamine2000 (Invitrogen) according to the manufacturer's instructions. After 24 hours, cells were harvested for Western blot analysis.

Western blot: Cells were washed with PBS, trypsinated, transferred to eppendorf tubes and 50 µl lysis buffer (1×RIPA) was added. The cell lysate was placed on ice for 20 min and spinned at 10.000 rpm for 10 minutes. Equal amounts (15 µl cell lysate) were loaded onto a 4-12% BIS-TRIS gel. The proteins were transferred to a nitrocellulose membrane using iBlot (Invitrogen) according to manufacturers instructions. The membrane was incubated overnight at 4° C. with the primary affinity purified rabbit serum antibody Pdcd4 (Rockland) with a 1:2000 concentration. As control, anti-beta tubulin antibodies (Thermo Scientific) were used at a 1:5000 dilution. Immunoreactive bands were visualized with ECL Plus (Amersham).

Example 24

Assessment of Potential Hepatotoxicity of the 8-mer Perfect Match LNA-AntimiR Compound 3205 (SEQ ID NO: 2) and the LNA Mismatch Control Compound 3218 (SEQ ID NO: 16).

Each compound was injected into female NMRI mice, at doses of 25 mg/kg, 5 mg/kg and 1 mg/kg, every other day for 2 weeks. The animals were sacrificed and serum was collected from whole blood for ALT and AST analyses. As seen in FIG. 23, the ALT and AST levels were not elevated for Compound 3205 (SEQ ID NO: 2) compared to saline or Compound 3218 (SEQ ID NO: 16) (mismatch control). However, one mouse showed increased levels (marked red), since the serum samples were contaminated with red blood cells, which contain 6-8 times higher levels of ALT and AST compared to plasma. The mice that received 5 mg/kg and 1 mg/kg were also analyzed for ALT and AST levels and showed no changes compared to saline treated control animals (data not shown).

Materials and Methods:
Experimental Design:

| Gr. no. | Animal IDno. | No. of mice | Compound Dose level per day | Conc. at dose vol. 10 ml/kg | Adm. Route | Dosing |
|---|---|---|---|---|---|---|
| 1 | 1-10 | 10 | NaCl 0.9% | — | i.v | 0, 2, 4, 7, 9 |
| 2 | 11-15 | 5 | Compound 3205 (SEQ ID NO: 2) 25 mg/kg | 2.5 mg/ml | i.v | 0, 2, 4, 7, 9 |
| 3 | 16-20 | 5 | Compound 3205 (SEQ ID NO: 2) 5 mg/kg | 0.5 mg/ml | i.v | 0, 2, 4, 7, 9 |
| 4 | 21-25 | 5 | Compound 3205 (SEQ ID NO: 2) 1 mg/kg | 0.1 mg/ml | i.v | 0, 2, 4, 7, 9 |
| 5 | 26-30 | 5 | Compound 3230 (SEQ ID NO: 16) 25 mg/kg | 2.5 mg/ml | i.v | 0, 2, 4, 7, 9 |
| 6 | 31-35 | 5 | Compound 3230 (SEQ ID NO: 16) 5 mg/kg | 0.5 mg/ml | i.v | 0, 2, 4, 7, 9 |

Sacrifice; The animals was sacrificed by cervical dislocation.

Sampling of serum for ALT/AST; The animals were anaesthetised with 70% $CO_2$-30% $O_2$ before collection of retro orbital sinus blood. The blood was collected into S-monovette Serum-Gel vials. The serum samples were harvested and stored from each individual mouse. The blood samples were stored at room temperature for two hours and thereafter centrifuged 10 min, 3000 rpm, at room temp. The serum fractions were harvested into Eppendorf tubes on wet ice.

ALT and AST measurements; ALT and AST measurements were performed in 96-well plates using ALT and AST reagents from ABX Pentra (A11A01627-ALT, A11A01629-AST) according to the manufacturer's instructions. In short, serum samples were diluted 2.5 fold with $H_2O$ and each sample was assayed in duplicate. After addition of 50 µl diluted sample or standard (multical from ABX Pentra—A11A01652) to each well, 200 µl of 37° C. AST or ALT reagent mix was added to each well. Kinetic measurements were performed for 5 min with an interval of 30s at 340 nm and 37° C.

Example 25

Assessment of PU.1 Protein Levels as a Functional Readout for miR-155 Antagonism by Short LNA-AntimiR (Compound 3207, SEQ ID NO: 4).

We have previously shown that the 8-mer (Compound 3207, SEQ ID NO: 4) antagonizing miR-155 leads to derepression of the miR-155 target c/EBPbeta in the mouse macrophage RAW cells. To further verify the potency of Compound 3207 (SEQ ID NO: 4) we determined the protein levels of another miR-155 target, PU.1 As a functional readout for miR-155 antagonism by short LNA-antimiR (Compound 3207, SEQ ID NO: 4) we performed Western blot. The antagonism was verified in the human monocytic THP-1 cell line which was transfected together with either an 8-mer (Compound 3207, SEQ ID NO: 4) perfect match or a 8-mer control LNA in the absence or presence of pre-miR-155. LPS was used to induce miR-155 accumulation and cells were harvested after 24 hours.

Results: THP-1 cells that were transfected with pre-miR-155 shows a decrease in PU.1 levels (FIG. 24). Transfecting the cells with the fully LNA-modified and phosphorothiolated Compound 3207 (SEQ ID NO: 4) effectively antagonizes miR-155, leading to unaltered levels of PU.1 protein. By comparison, transfecting the cells with an 8-mer LNA control, PU.1 levels decreased, indicating that antagonism of miR-155 by Compound 3207 (SEQ ID NO: 4) LNA-antimiR is specific.

Conclusion: Antagonism of miR-155 using an 8-mer leads to de-repression of the direct target PU.1 in human THP-1 cells.

Materials and Methods:

Cell line: The human monocytic THP-1 cell line was purchased from ECACC (#88081201). THP-1 cells were cultured in RPMI with L-glutamine, supplemented with 10% fetal bovine serum.

Transfection: 200.000 cells were seeded per well in a 12-well plate the day before. On the day of transfection, THP-1 cells were transfected with 5 nmol pre-miR-155 (Ambion) and/or 5 nM LNA-antimiR together with Lipofectamine2000 (Invitrogen) according to the manufacturer's instructions. LPS (100 ng/ml) was added to the cells after the 4 hour incubation with the transfection complexes. After 24 hours, cells were harvested for protein extraction and western blot analysis.

Western blot: Cells were washed with PBS, trypsinated, transferred to eppendorf tubes and 50 µl lysis buffer (1×RIPA) was added. The cell lysate was placed on ice for 20 min and spinned at 10.000 rpm for 10 minutes. Equal amounts (15 µl cell lysate) were loaded onto a 4-12% BIS-TRIS gel. The proteins were transferred to a nitrocellulose membrane using iBlot (Invitrogen) according to manufacturers instructions The membrane was incubated overnight at 4° C. with the rabbit monoclonal PU.1 antibody (Cell Signaling) with a 1:2000 concentration. As equal loading, Tubulin (Thermo Scientific) was used at a 1:5000 dilution. Immunoreactive bands were visualized with ECL Plus (Amersham).

Example 26

Assessment of p27 Protein Levels as a Functional Readout for Antagonism of the miR-221/222 Family by the 7-mer Compound 3225 (SEQ ID NO: 23) LNA-AntimiR.

Previous work has shown (le Sage et al. 2007, Galardi et al. 2007) that miR-221 and miR-222 post-transcriptionally regulate the expression of the tumour suppressor gene p27, which is involved in cell cycle regulation. In these studies, downregulation of miR-221 and miR-222 was shown to increase expression levels of p27. Thus, as a functional readout for antagonism of the miR-221/222 family by the 7-mer Compound 3225 (SEQ ID NO: 23) LNA-antimiR we determined the protein levels of p27 after transfection of the LNA-antimiR Compound 3225 (SEQ ID NO: 23) into PC3 cells.

Results: As shown in FIG. 25, transfection of the 7-mer LNA-antimiR Compound 3225 (SEQ ID NO: 23) targeting the seed sequence of miR-221 and miR-222 resulted in dose-dependent increase of the p27 protein levels compared to either untransfected or our LNA scrambled control transfected PC3 cells. These results clearly demonstrate that the 7-mer LNA-antimiR is able to effectively antagonize the miR-221/222 family leading to de-repression of the direct target p27 at the protein level at concentrations as low as 5 nM.

Conclusion: A fully LNA-modified 7-mer LNA-antimiR targeting the seed sequence in the miR-221/222 family at 5 nM can effectively antagonize both miRNAs leading to de-repression of the direct target p27 at protein level.

Materials and Methods:

Cell line: The human prostate carcinoma PC3 cell line was purchased from ECACC (#90112714). PC3 cells were cultured in DMEM medium, supplemented with 10% fetal bovine serum, 2 mM Glutamax and 25 ug/ml Gentamicin.

Transfection: 250.000 cells were seeded per well in a 6-well plate the day before transfection in order to receive 50% confluency the next day. On the day of transfection, PC3 cells were transfected with LNA-oligonucleotides at varying concentrations (see FIG. 25) with Lipofectamine2000. Cells were harvested after 24 hours for protein extraction and western blot analysis.

Western blot: Cells were washed with PBS, trypsinated, transferred to eppendorf tubes and 50 μl lysis buffer (1×RIPA) was added. The cell lysate was placed on ice for 20 min, then spinned at 10.000 rpm for 10 minutes. Equal amounts (15 μl cell lysate) were loaded onto a 4-12% BIS-TRIS gel. The proteins were transferred to a nitrocellulose membrane using iBlot (Invitrogen) according to manufacturers instructions. The membrane was incubated overnight at 4° C. with the primary monoclonal mouse antibody p27 (BD Biosciences) at a 1:1000 dilution. As loading control, Tubulin (Thermo Scientific) was used at a 1:5000 dilution. Immunoreactive bands were visualized with ECL Plus (Amersham).

Example 27

Knock-Down of miR-221/222 by the 7-mer Compound 3225 (SEQ ID NO: 23) LNA-AntimiR Reduces Colony Formation of PC3 Cells A hallmark of cellular transformation is the ability for tumour cells to grow in an anchorage-independent way in semisolid medium. We have therefore performed soft agar assay which is a phenotypic assay that is relevant for cancer, given that it measures the decrease of tumour cells. We transfected Compound 3225 (SEQ ID NO: 23) (perfect match) and Compound 3231 (SEQ ID NO: 28) (scrambled) into PC3 cells, and after 24 hours plated cells in soft agar. Colonies were counted after 12 days. We show in FIG. 26 that inhibition of miR-221 and miR-222 by Compound 3225 (SEQ ID NO: 23) can reduce the amount of colonies growing in soft agar compared to the scrambled control LNA-antimiR, indicating decrease of tumour cells.

Conclusion: The 7-mer (Compound 3225, SEQ ID NO: 23) targeting the miR-221/222 family reduces the number of colonies in soft agar, indicating proliferation arrest of PC3 cells.

Materials and Methods:

Cell line: The human prostate carcinoma PC3 cell line was purchased from ECACC (#90112714). PC3 cells were cultured in DMEM medium, supplemented with 10% fetal bovine serum, 2 mM Glutamax and 25 ug/ml Gentamicin.

Transfection: 250.000 cells were seeded per well in a 6-well plate the day before transfection in order to receive 50% confluency the next day. On the day of transfection, PC3 cells were transfected with 25 nM of different LNA oligonucleotides with Lipofectamine2000.

Clonogenic growth in soft agar: $2.5 \times 10^3$ PC3 cells were seeded in 0.35% agar on the top of a base layer containing 0.5% agar. Cells were plated 24 hours after transfection. Plates were incubated in at 37° C., 5% $CO_2$ in a humified incubator for 12 days and stained with 0.005% crystal violet for 1 h, after which cells were counted. The assay was performed in triplicate.

Example 28

Assessment of let-7 Antagonism by 6-9-mer LNA-AntimiRs in Huh-7 Cells Transfected with let-7a Precursor miRNA, and a Luciferase Sensor Assay In order to assess the efficiency of fully LNA-modified 6-9-mer oligonucleotides in targeting and antagonizing the let-7 family of miRNAs, a luciferase sensor construct was made, containing some 800 bp of the HMGA2 3'UTR. The sequence cloned into the vector contains four out of seven functional let-7 binding sites (sites 2-5), as previously demonstrated by Mayr et al. (Science, 2007) and Lee and Dutta (Genes Dev, 2007). In order to monitor let-7 inhibition, the hepatocellular carcinoma cell line Huh-7 (with low to non-existing levels of endogenous let-7) was transfected with the luciferase sensor construct, with let-7a precursor miRNA, and with the 6-9 mer let-7 antagonists Compound 3232 (SEQ ID NO: 29), Compound 3233 (SEQ ID NO: 30), Compound 3227 (SEQ ID NO: 25), Compound 3234 (SEQ ID NO: 31), Compound 3235 (SEQ ID NO: 32); see FIG. 27) at increasing concentrations. The 6-9-mer LNA-antimiRs were compared with Compound 3226 (SEQ ID NO: 33), a 15-mer against let-7a as a positive control. After 24 hours, luciferase activity was measured.

Results: As seen in FIG. 28, the fully LNA-modified 8- and 9-mer LNA-antimiRs (Compound 3227 (SEQ ID NO: 34), Compound 3234 (SEQ ID NO: 31), and Compound 3235 (SEQ ID NO: 32)) show similar potencies in de-repressing the let-7 targets in the luciferase sensor assay, as the positive control 15-mer Compound 3226 (SEQ ID NO: 24). Full target de-repression for these highly potent compounds is achieved already at 1-5 nM, whereas the 7-mer Compound 3233 (SEQ ID NO: 30) needs to be present at slightly higher concentrations (10 nM) to generate the same effect. However, the 6-mer Compound 3232 (SEQ ID NO: 29) shows no effect even at as high concentrations as 50 nM. The de-repression of luciferase activity by the 7-9- and the 15-mer LNA-antimiRs is dose-dependent, which is particularly clear in the case of the slightly less potent Compound 3233 (SEQ ID NO: 30).

Conclusion: To conclude, the 8-9-mer LNA-antimiRs (Compound 3227 (SEQ ID NO: 25), Compound 3234 (SEQ ID NO: 31), and Compound 3235 (SEQ ID NO: 32)) show equal antagonist potencies in inhibition of let-7a in vitro compared to the 15-mer LNA-antimiR Compound 3226 (SEQ ID NO: 24) targeting let-7a. A potent effect, albeit at slightly higher concentrations is also seen for the 7-mer Compound 3233 (SEQ ID NO: 30), whereas a 6-mer has no effect at tested concentrations.

Materials and Methods:

Cell line: The hepatocellular carcinoma cell line Huh-7 was a kind gift from R. Bartinschlager (Dept Mol Virology, University of Heidelberg). Huh-7 cells were cultured in DMEM medium, supplemented with 10% fetal bovine serum, 2 mM Glutamax, 1×NEAA and 25 ug/ml Gentamicin.

Transfection: 8,000 cells were seeded per well in a 96-well plate the day before transfection in order to receive 60-80% confluency the next day. On the day of transfection, Huh-7 cells in each well were transfected with 20 ng HMGA2 3'UTR/psiCHECK2 plasmid, let-7a precursor miRNA (Dharmacon; 10 nM end-concentration), LNA-antimiRs Compound 3232 (SEQ ID NO: 29), Compound 3233 (SEQ ID NO: 30), Compound 3227 (SEQ ID NO: 25), Compound 3234 (SEQ ID NO: 31), Compound 3235 (SEQ ID NO: 32), Compound 3226 (SEQ ID NO: 24); 0-50 nM end concentrations) together with 0.17 µl Lipofectamine2000 (Invitrogen) according to manufacturer's instructions. After 24 hours, cells were harvested for luciferase measurements.

Luciferase assay: Growth media was discarded and 30 µl 1× Passive Lysis Buffer (Promega) was added to each well. After 15-30 minutes of incubation on an orbital shaker, *renilla* and firefly luciferase measurements were performed according to manufacturer's instructions (Promega).

Example 29

Assessment of Entire let-7 Family Antagonism by 8-, and 15-mer LNA-AntimiRs in Huh-7 Cells Transfected with a Luciferase Sensor Assay In order to assess the efficiency of a fully LNA-modified 8-mer oligonucleotide in antagonizing the entire let-7 family of miRNAs, the same luciferase sensor construct as described in the previous example was used. Again, Huh-7 cells (with low to non-existing levels of endogenous let-7) were transfected with the sensor construct, with one of the family-representative let-7a, let-7d, let-7e, or let-7l precursors, and with the antagonist Compound 3227 (SEQ ID NO: 25) at increasing concentrations. The 8-mer LNA-antimiR was compared to Compound 3226 (SEQ ID NO: 24), a 15-mer against let-7a as a positive and potent control. After 24 hours, luciferase activity was measured.

Results: As seen in FIG. 29 the fully LNA-modified 8-mer LNA-antimiRs (Compound 3227) (SEQ ID NO: 25) show similar potencies in de-repressing the various let-7 targets in the luciferase sensor assay, as the positive control 15-mer Compound 3226 (SEQ ID NO: 24). Nearly full target de-repression for the 8-mer is achieved already at 0.5-1 nM, except in the case with let-7e premiR (FIG. 29C), to which only 7 out of 8 nucleotides of Compound 3227 (SEQ ID NO: 25) hybridizes to the target. However, despite the terminal mismatch in this case, Compound 3227 (SEQ ID NO: 25) generates full target de-repression at 5 nM. The positive control 15-mer shows potent antagonism of all precursors and gives nearly full de-repression at 0.5 nM. The de-repression of luciferase activity by both the 8- and the 15-mer LNA-antimiRs is clearly dose-dependent, as seen in all four panels (FIGS. 29A-D).

Conclusion: To conclude, the 8-mer LNA-antimiR (Compound 3227, SEQ ID NO: 25), is a potent antagonist against four representative let-7 family members in vitro, and thus likely against the entire family. Compared to a 15-mer positive control antagonist, Compound 3226 (SEQ ID NO: 24), the 8-mer is equally potent for three of four targets, and slightly less potent for the fourth target, let-7e, explained by a terminal mismatch in this case.

Materials and Methods:

Cell line: The hepatocellular carcinoma cell line Huh-7 was a kind gift from R. Bartinschlager (Dept Mol Virology, University of Heidelberg). Huh-7 cells were cultured in DMEM medium, supplemented with 10% fetal bovine serum, 2 mM Glutamax, 1×NEAA and 25 ug/ml Gentamicin.

Transfection: 8,000 cells were seeded per well in a 96-well plate the day before transfection in order to receive 60-80% confluency the next day. On the day of transfection, Huh-7 cells in each well were transfected with 20 ng HMGA2 3'UTR/psiCHECK2 plasmid, with let-7a, -7d, -7e, or -7i precursor miRNA (Dharmacon; 10 nM end-concentration), and with LNA-antimiRs Compound 3227 (SEQ ID NO: 25) and Compound 3226 (SEQ ID NO: 24); 0-50 nM end concentrations) together with 0.17 µl Lipofectamine-2000 (Invitrogen) according to manufacturer's instructions. After 24 hours, cells were harvested for luciferase measurements.

Luciferase assay: Growth medium was discarded and 30 µl 1× Passive Lysis Buffer (Promega) was added to each well. After 15-30 minutes of incubation on an orbital shaker, renilla and firefly luciferase measurements were performed according to manufacturer's instructions (Promega).

Example 30

Assessment of Endogenous Let-7 Antagonism by Compound 3227 (SEQ ID NO: 25), an 8-mer LNA-AntimiRs, in HeLa Cells Transfected with a Luciferase Sensor Assay.

In order to determine the efficiency of a fully LNA-modified 8-mer oligonucleotide in targeting and antagonizing endogenous let-7, the same luciferase sensor construct as described in previous two examples, was co-transfected with Compound 3227 (SEQ ID NO: 25) into the cervical cancer cell line HeLa (that expresses moderate to high levels of let-7 as determined by Q-PCR; data not shown). Empty psiCHECK-2 vector was included as a negative control.

Results: As seen in FIG. 30, the fully LNA-modified 8-mer LNA-antimiR Compound 3227 (SEQ ID NO: 25) shows potent antagonism of endogenous let-7, and gives full target de-repression at concentrations of 5-10 nM. The de-repression of luciferase activity is dose-dependent, starting around 1 nM and reaching a plateau at approximately 10 nM.

Conclusion: To conclude, the 8-mer LNA-antimiR (Compound 3227, SEQ ID NO: 25), is a potent antagonist against also endogenous let-7 in vitro, and thus provides definite evidence that entire miRNA families can be successfully targeted by short and fully LNA-modified antagonists.

Materials and Methods:

Cell line: The cervical cancer cell line HeLa was purchased from ATCC (#CCL-2™). HeLa cells were cultured in Eagle's MEM medium, supplemented with 10% fetal bovine serum, 2 mM Glutamax, 1×NEAA and 25 ug/ml Gentamicin.

Transfection: 8,000 cells were seeded per well in a 96-well plate the day before transfection in order to receive 50-70% confluency the next day. On the day of transfection, HeLa cells in each well were co-transfected with 20 ng HMGA2 3'UTR/psiCHECK2 plasmid or psiCHECK-2 (empty vector), and with LNA-antimiR Compound 3227 (SEQ ID NO: 25) (0-50 nM, end concentrations) together with 0.17 µl Lipofectamine2000 (Invitrogen) according to manufacturer's instructions. After 24 hours, cells were harvested for luciferase measurements.

Luciferase assay: Growth media was discarded and 30 µl 1× Passive Lysis Buffer (Promega) was added to each well. After 15-30 minutes of incubation on an orbital shaker, renilla and firefly luciferase measurements were performed according to manufacturer's instructions (Promega).

Example 31

Assessment of miR-21 Antagonism by an 8-mer LNA-AntimiR-21 (Compound 3205, SEQ ID NO: 2) Versus an 8-mer (Compound 3219, SEQ ID NO: 17) Scrambled Control LNA in the Human Colon Carcinoma Cell Line HCT116

We have previously shown in this application, that an 8-mer LNA-antimiR that is fully LNA-modified and phosphorothiolated effectively antagonizes miR-21 in the human cervix carcinoma cell line HeLa, the human breast carcinoma cell line MCF-7, the human prostate cancer cell line PC3 and human hepatocellular carcinoma HepG2 cell line. We extended this screening approach to the human colon carcinoma cell line HCT116. To assess the efficiency of the 8-mer LNA-antimiR oligonucleotide against miR-21, luciferase reporter constructs were generated in which a perfect match target site for the mature miR-21 was cloned into the 3'UTR of the *Renilla* luciferase gene. In order to monitor miR-21 inhibition, HCT116 cells were transfected with the luciferase constructs together with the miR-21 antagonist Compound 3205 (SEQ ID NO: 2) (8-mer) and for comparison of specificity with the 8-mer LNA scrambled control (Compound 3219, SEQ ID NO: 17). After 24 hours, luciferase activity was measured.

Results: The luciferase reporter experiments showed a dose-dependent de-repression of the luciferase miR-21 reporter activity with the 8-mer LNA-antimiR against miR-21 (Compound 3205, SEQ ID NO: 2) and complete de-repression was obtained at 5 nM (FIG. 31). When comparing the specificity of the 8-mer perfect match and the 8-mer scrambled control, the scrambled control LNA-antimiR (Compound 3219, SEQ ID NO: 17) did not show any de-repression at all, demonstrating high specificity of the LNA-antimiR compound against miR-21.

Conclusion: The 8-mer (Compound 3205, SEQ ID NO: 2) is potent in targeting miR-21 and antagonism of miR-21 by Compound 3205 (SEQ ID NO: 2) is specific.

Materials and Methods:

Cell line: The human colon carcinoma HCT116 cell line was purchased from ATCC(CCL-247). HCT116 cells were cultured in RPMI medium, supplemented with 10% fetal bovine serum, and 25 ug/ml Gentamicin.

Transfection: 110.000 cells were seeded per well in a 12-well plate and transfection was performed. HCT116 cells were transfected with 0.3 μg miR-21 luciferase sensor plasmid or empty psiCHECK2 vector together with 1.2 μl Lipofectamine2000 (Invitrogen) according to the manufacturer's instructions. Transfected were also varying concentrations of LNA-antimiR and control oligonucleotides. After 24 hours, cells were harvested for luciferase measurements.

Luciferase assay: The cells were washed with PBS and 250 μl 1× Passive Lysis Buffer (Promega) was added to the wells. The plates were placed on a shaker for 30 min., after which the cell lysates were transferred to eppendorf tubes. The cell lysate was centrifugated for 10 min at 2.500 rpm after which 50 μl were transferred to a 96 well plate and luciferase measurements were performed according to the manufacturer's instructions (Promega).

Example 32

Knock-Down of miR-21 by the 8-mer Compound 3205 (SEQ ID NO: 2) LNA-AntimiR Reduces Colony Formation of PC3 Cells A hallmark of cellular transformation is the ability for tumour cells to grow in an anchorage-independent way in semisolid medium. We therefore performed soft agar assay which is a phenotypic assay that is relevant for cancer, given that it measures the decrease of tumour cells. We transfected Compound 3205 (SEQ ID NO: 2) (perfect match LNA-antimiR-21) and Compound 3219 (SEQ ID NO: 17) (LNA scrambled control) into PC3 cells, and after 24 hours plated cells in soft agar. Colonies were counted after 12 days. We show in FIG. 32 that inhibition of miR-21 by Compound 3205 (SEQ ID NO: 2) can reduce the amount of colonies growing in soft agar compared to the scrambled control LNA treated or untreated control (transfected, but with no LNA), demonstrating decrease of tumour cells.

Conclusion: The 8-mer (Compound 3205, SEQ ID NO: 2) targeting the miR-21 family reduces the number of colonies in soft agar, demonstrating proliferation arrest of PC3 cells.

Materials and Methods:

Cell line: The human prostate carcinoma PC3 cell line was purchased from ECACC (#90112714). PC3 cells were cultured in DMEM medium, supplemented with 10% fetal bovine serum, 2 mM Glutamax and 25 ug/ml Gentamicin.

Transfection: 250.000 cells were seeded per well in a 6-well plate the day before transfection in order to receive 50% confluency the next day. On the day of transfection, PC3 cells were transfected with 25 nM of different LNA oligonucleotides with Lipofectamine2000.

Clonogenic growth in soft agar: $2.5 \times 10^3$ PC3 cells were seeded in 0.35% agar on the top of a base layer containing 0.5% agar. Cells were plated 24 hours after transfection. Plates were incubated in at 37° C., 5% $CO_2$ in a humified incubator for 12 days and stained with 0.005% crystal violet for 1 h, after which cells were counted. The assay was performed in triplicate.

Example 33

Silencing of miR-21 by the 8-mer Compound 3205 (SEQ ID NO: 2) LNA-AntimiR Reduces Colony Formation of HepG2 Cells miR-21 is overexpressed in the human hepatocellular carcinoma cell line HepG2 and we have previously shown that we are able to regulate the luciferase activity of a miR-21 sensor plasmid with Compound 3205 (SEQ ID NO: 2) in these cells. HepG2 cells were transfected with Compound 3205 (SEQ ID NO: 2) and Compound 3219 (SEQ ID NO: 17) (scrambled 8-mer), and after 24 hours plated into soft agar. Colonies were counted after 17 days with a microscope.

Results: We show in FIG. 33 that inhibition of miR-21 by Compound 3205 (SEQ ID NO: 2) can reduce the amount of colonies growing in soft agar, showing that proliferation arrest has occurred. In addition, our scrambled 8-mer control, Compound 3219 (SEQ ID NO: 17), had no significant effect on the number of colonies.

Conclusion: The 8-mer (Compound 3205, SEQ ID NO: 2) targeting the miR-21 reduces the number of colonies in soft agar, indicating proliferation arrest of HepG2 cells.

Materials and Methods:

Cell line: The human hepatocytic HepG2 cell line was purchased from ECACC (#85011430). HepG2 cells were cultured in EMEM medium, supplemented with 10% fetal bovine serum, 2 mM Glutamax and 25 ug/ml Gentamicin.

Transfection: 650.000 cells were seeded per well in a 6-well plate and reverse transfection was performed. HepG2 cells were transfected with 0.6 mg miR-21 luciferase sensor plasmid or empty psiCHECK2 vector together with 2.55 μl Lipofectamine2000 (Invitrogen) according to the manufacturer's instructions. Transfected were also LNA-antimiR and control oligonucleotides as varying concentrations. After 24 hours, the cells were harvested for luciferase measurements.

Clonogenic growth in soft agar: $2.0 \times 10^3$ HepG2 cells were seeded in 0.35% agar on the top of a base layer containing 0.5% agar. Cells were plated 24 hours after transfection. Plates were incubated in at 37° C., 5% $CO_2$ in a humified incubator for 17 days and stained with 0.005% crystal violet for 1 h, after which cells were counted. The assay was performed in triplicate.

Example 34

Figure 34A:
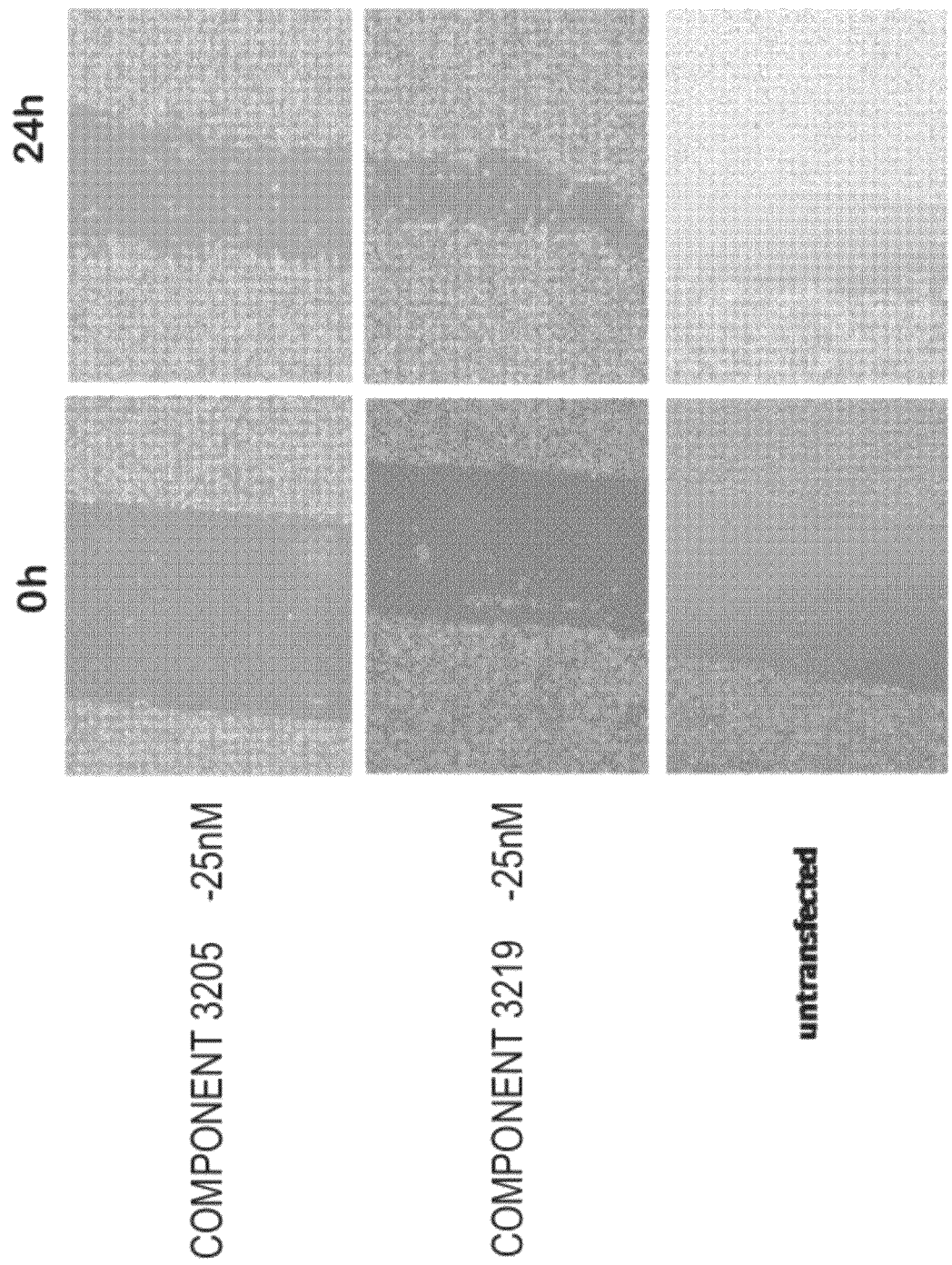
Figure 34B:
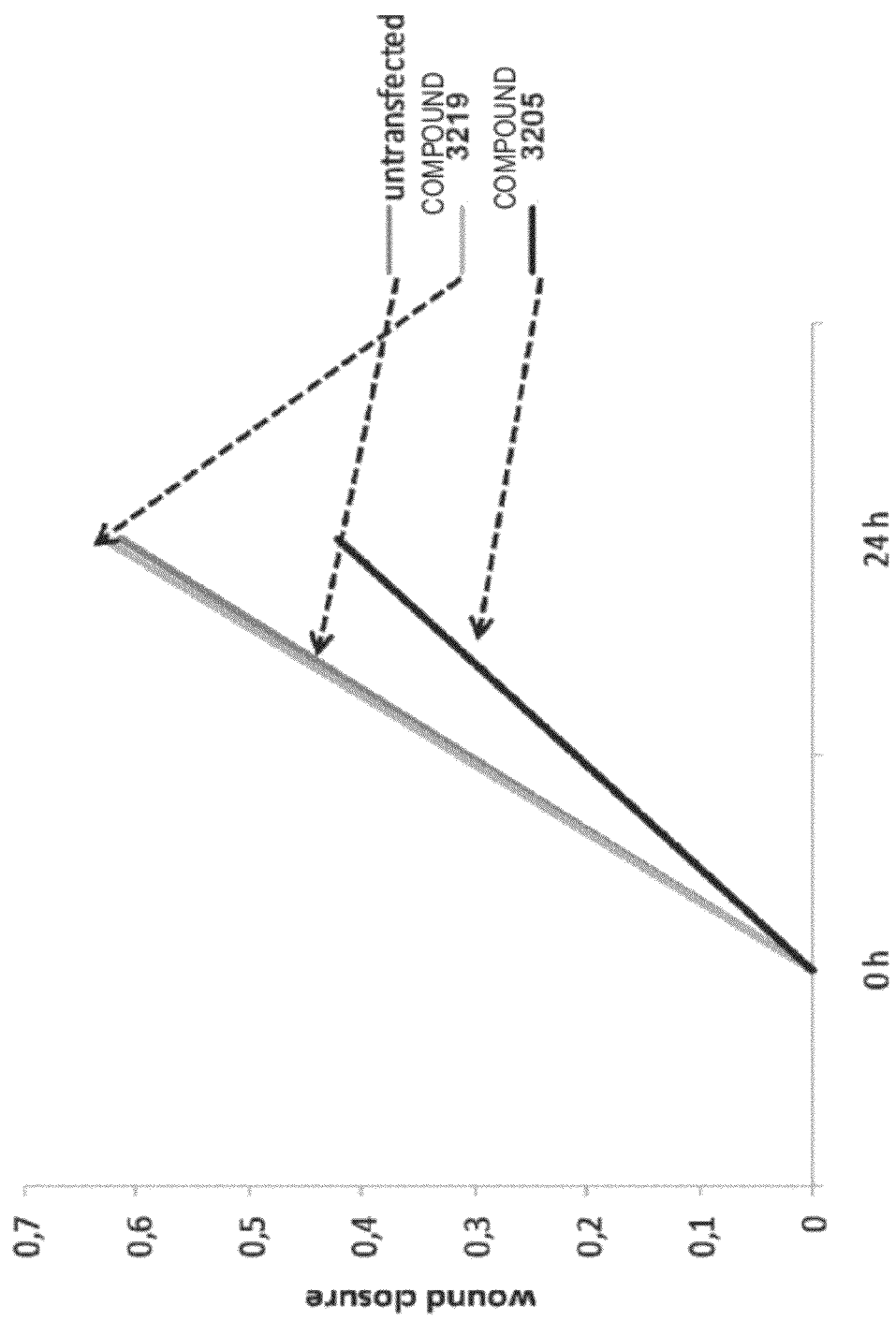

Silencing of miR-21 by the 8-mer Compound 3205 (SEQ ID NO: 2) LNA-AntimiR Inhibits Cell Migration in PC3 Cells Cell migration can be monitored by performing a wound healing assay (=scratch assay) where a "scratch" is made in a cell monolayer, and images are captured at the beginning and at regular intervals during cell migration. By comparing the images, quantification of the migration rate of the cells can be determined. This was done in the human prostate cancer cell line PC3. Cells were seeded, and on day 3 the cells were transfected, and the next day, when 100% confluency was reached, a scratch (=wound) was made. When the scratch was made, pictures were taken in order to document the initial wound. Afterwards the area of the wound closure is measured at different time points with the free software program Image J. As shown in FIG. 34A, PC3 cells had been treated with 25 nM Compound 3205 (SEQ ID NO: 2) (perfect match, miR-21), the control Compound 3219 (SEQ ID NO: 17) or left untransfected. Pictures were taken after 24 hours, and the area was calculated for the wound closure at respective time-point. The wound closure for the untransfected cells and for the control, Compound 3219 (SEQ ID NO: 17), was faster as compared to our LNA-antimiR against miR-21, Compound 3205 (SEQ ID NO: 2), indicating that Compound 3205 (SEQ ID NO: 2) inhibits miR-21 and prevents the cells from migrating (FIG. 34B).

Conclusion: The 8-mer (Compound 3205, SEQ ID NO: 2) targeting miR-21 inhibits the cell migration of PC3 cells compared to untransfected and control transfected cells.

Materials and Methods:

Cell line: The human prostate carcinoma PC3 cell line was purchased from ECACC (#90112714). PC3 cells were cultured in DMEM medium, supplemented with 10% fetal bovine serum, 2 mM Glutamax and 25 ug/ml Gentamicin.

Scratch assay: 150.000 cells were seeded per well in a 6-well plate three days before transfection in order to receive 100% confluency the next day. At 24 hours after transfection, a scratch was made in the cell monolayer with a 200 µl tip. Pictures were taken at 0 h and after 24 hours by using a digital camera coupled to a microscope. The software program Image J was used to determine wound closure.

Example 35

Length Assessment of Fully LNA-Substituted LNA-AntimiRs Antagonizing miR-155

We have previously shown a length assessment for miR-21 regarding fully LNA-substituted LNA-antimiRs, and showed that the most potent LNA-antimiRs are 7-, 8- or 9 nt in length. The same experiment was repeated with miR-155. A perfect match target site for miR-155 was cloned into the 3'UTR of the luciferase gene in the reporter plasmid psiCHECK2 and transfected into the mouse RAW macrophage cell line together with fully LNA-substituted LNA-antimiRs of different lengths. Because the endogenous levels of miR-155 are low in the RAW cell line, the cells were treated with 100 ng/ml LPS for 24 hours in order to induce miR-155 accumulation. After 24 hours, luciferase analysis was performed.

Results: As shown in FIG. 35, the most potent LNA-antimiRs are Compound 3207 (SEQ ID NO: 4) (8 nt) and Compound 3241 (SEQ ID NO: 38) (9 nt), reaching almost a 80% de-repression at only 0.25 nM LNA concentration. The 6-mer (Compound 3244, SEQ ID NO: 978) shows no significant de-repression. Increasing the length to 12-mer to 14-mer (Compound 3242 (SEQ ID NO: 39) and Compound 3243 (SEQ ID NO: 977)) decreased the potency as shown by less efficient de-repression of the miR-155 reporter.

Conclusion: The most potent fully LNA-substituted LNA-antimiRs targeting miR-155 were an 8- and 9-mer (Compound 3207 (SEQ ID NO: 4) and Compound 3241 (SEQ ID NO: 38)).

Materials and Methods:

Cell line: The mouse macrophage RAW 264.7 cell line was purchased from ATCC (TIB-71). RAW cells were cultured in DMEM medium, supplemented with 10% fetal bovine serum, 4 mM Glutamax and 25 ug/ml Gentamicin.

Transfection: 500.000 cells were seeded per well in a 6-well plate the day before transfection in order to receive 50% confluency the next day. On the day of transfection, RAW 264.7 cells were transfected with 0.3 ug miR-155 perfect match/psiCHECK2 or empty psiCHECK2 vector together with 10 µl Lipofectamine2000 (Invitrogen) according to the manufacturer's instructions. Transfected was also varying concentrations of LNA-antimiRs. In order to induce miR-155 accumulation, LPS (100 ng/ml) was added to the RAW cells after the 4 hour incubation with the transfection complexes. After another 24 hours, cells were harvested for luciferase measurements.

Luciferase assay: The cells were washed with PBS and harvested with cell scraper, after which cells were spinned for 5 min at 2.500 rpm. The supernatant was discarded and 50 ml 1× Passive Lysis Buffer (Promega) was added to the cell pellet, after which cells were put on ice for 30 min. The lysed cells were spinned at 10.000 rpm for 30 min after which 20 µl were transferred to a 96-well plate and luciferase measurements were performed according to the manufacturer's instructions (Promega).

Example 36

Plasma Protein Binding for the Fully LNA-Substituted 8-Mer Compound 3205 (SEQ ID NO: 2) Targeting miR-21 (LNA-AntimiR-21).

Figure 36A:
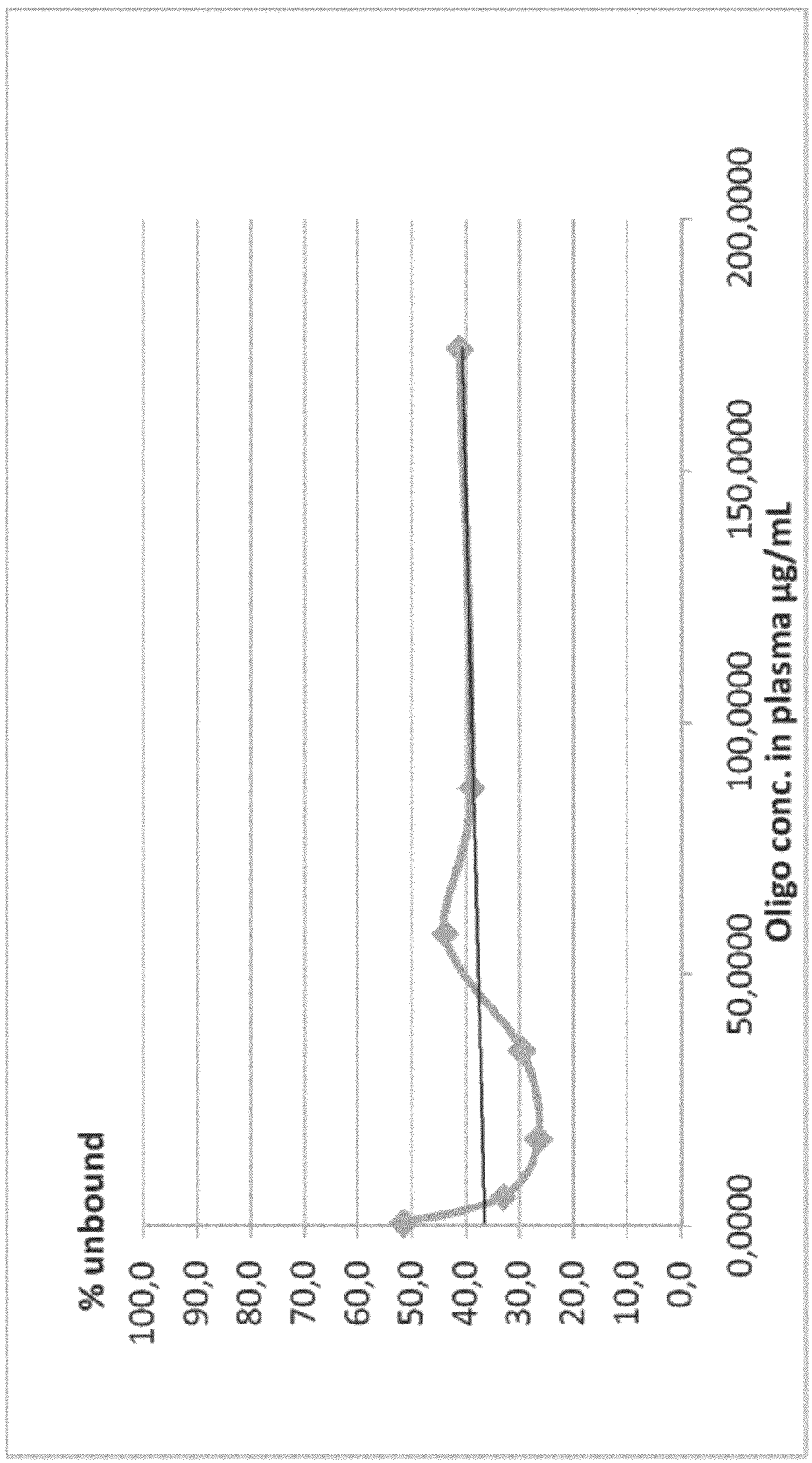
Figure 36B:
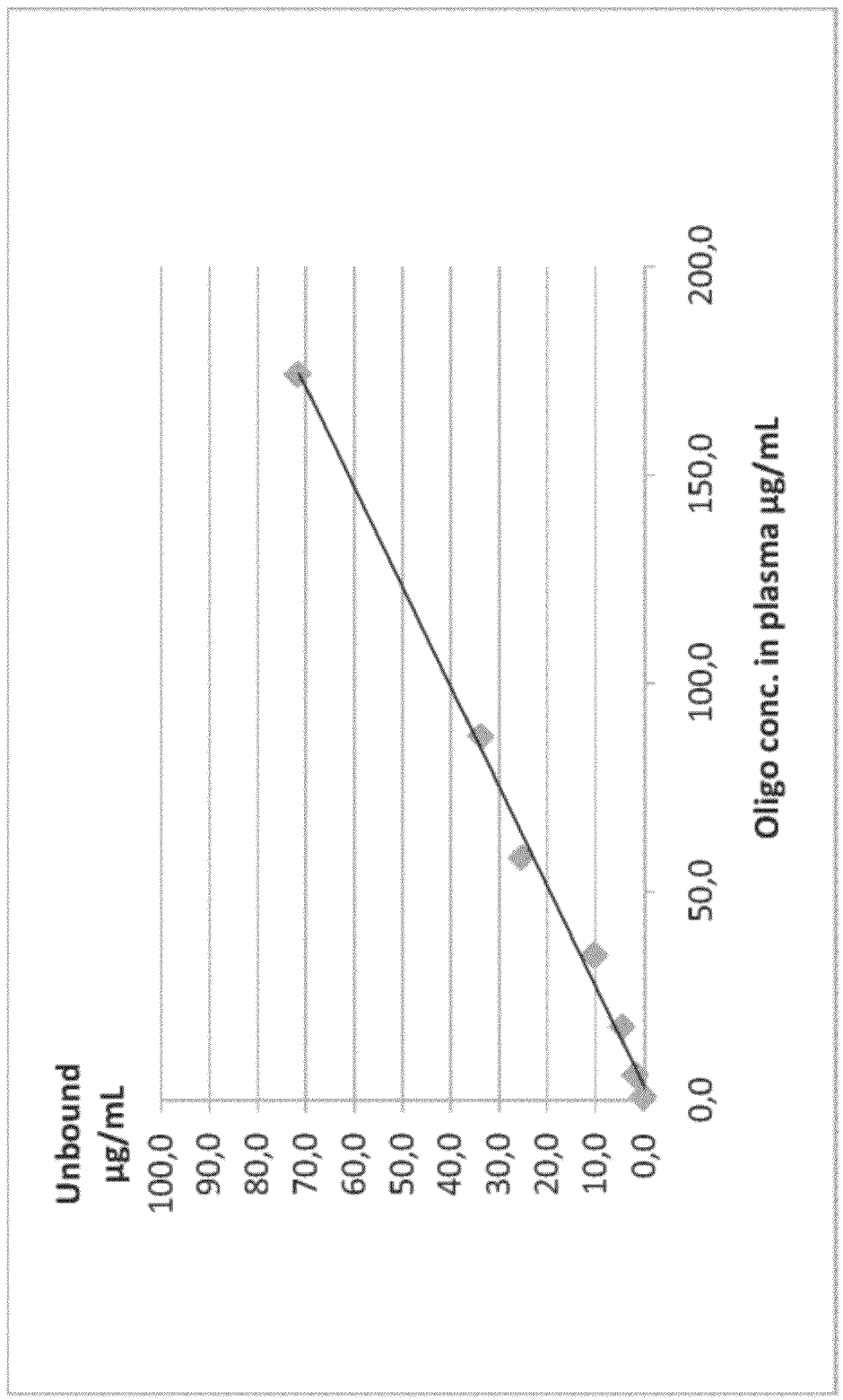

The plasma proteins are not saturated with Compound 3205 (SEQ ID NO:2) at the plasma concentrations in the experiment shown in FIG. 36A. In a wide range of Compound 3205 (SEQ ID NO: 2) concentrations in the plasma the protein binding is around 95% of the Compound 3205 (SEQ ID NO: 2) LNA-antimiR-21 in FIG. 36B. At Compound 3205 (SEQ ID NO: 2) concentrations 50.1 µM (174 µg/mL) the binding capacity of plasma proteins for FAM-labeled Compound 3205 (SEQ ID NO: 2) has not been saturated.

Materials and Methods: Mouse plasma (100 µL) was spiked with FAM-labeled Compound 3205 (SEQ ID NO: 2) to 0.167, 1.67, 5.01, 10.02, 16.7, 25.05 and 50.1 µM concentrations. The solutions were incubated at 37° C. for 30 minutes. The solutions were transferred to a Microcon Ultracel YM-30 filter (regenerated cellulose 30.000 MWCO). The filters were spun for 20 minutes at 2000 g and at room temperature in a microcentrifuge. The filtrate was diluted 5, 10 and 20 times and 100 µL samples were transferred to a microtiter plate (Polystyrene Black NUNC-237108). The fluorescence was detected using a FLUOstar Optima elisa reader with excitation 458 nm and emission 520 nm. The amount of unbound FAM-labeled Compound 3205 (SEQ ID NO: 2) was calculated from a standard curve derived from filtrated plasma spiked with FAM-labeled Compound 3205 (SEQ ID NO: 2) at 12 different (0.45-1000 nM) concentrations. The numbers were corrected with the recovery number established from filtration experiments with Compound 3205 (SEQ ID NO: 2) concentrations 0.167, 1.67, 5.01, 10.02, 16.7, 25.05 and 50.1 µM in filtrated plasma. The recovery of FAM-labeled Compound 3205 (SEQ ID NO: 2) was 86%.

Example 37

Quantitative Whole Body Autoradiography Study in Female Pigmented Mice After Single Intravenous Administration of $^{35}$S-Labelled Compound 3205 (SEQ ID NO: 2) LNA-AntimiR-21

In order to determine the biodistribution of a short fully LNA-modified LNA-antimiR (Compound 3205 (SEQ ID NO: 2), 8-mer) a whole body tissue distribution of radioactively labeled compound was done in mice. $^{35}$S-labelled Compound 3205 (SEQ ID NO: 2) was dosed to mice with a single intravenous administration and mice were sacrificed at different time-points, ranging from 5 min to 21 days.

TABLE 6(i)

Individual tissue concentrations (µg Compound 3205/g tissue) after a single intravenous administration of $^{35}$S-labelled Compound 3205 (SEQ ID NO: 2) in female pigmented mice.

| Tissue | Max. Conc. of oligo µg Compound 3205/g tissue | Time of max conc. hours | T½ hours |
|---|---|---|---|
| Adrenal gl. | 13.6 | 0.083 | 374 |
| Bile | 4 | 1 | |
| Bone marrow | 7.2 | 0.083 | 411 |
| Brain | 0.4 | 0.083 | |
| Brown fat | 8.8 | 0.083 | |
| Gastric muc. | 10.1 | 0.083 | |
| Heart blood | 26.2 | 0.083 | 10.3 |
| Kidney ctx. | 58.7 | 24 | 104 |
| Liver | 11.8 | 0.083 | 588 |
| | 10.7 | 24 | |
| Lung | 13.2 | 0.083 | 289 |
| Lymph node | 5 | 0.083 | 262 |
| | 2.4 | 48 | |
| Lymph | 18.8 | 4 | |
| | 20.8 | 168 | |
| Myocardium | 8.1 | 0.083 | 662 |
| Ovary | 13 | 0.083 | 198 |
| Pancreas | 5 | 0.083 | |
| Pituitary gl. | 6.7 | 0.083 | |
| Salivary gl. | 8.6 | 0.083 | 405 |
| | 5.5 | 168 | |
| skel. Muscle | 4.8 | 0.083 | |
| Skin pig. | 5.4 | 0.25 | |
| Spleen | 9.8 | 0.083 | 564 |
| Thymus | 3.8 | 0.083 | 185 |
| Thyroid gl. | 10.9 | 0.083 | 592 |
| Urine | 328.9 | 0.083 | |
| Uterus | 9.6 | 0.25 | 177 |
| Uvea of the eye | 13.6 | 0.083 | |
| LOQ | 0.045 | 0.083 | |
| | 0.033 | 24 | |
| | 0.03 | 168 | |

The figures are mean values of three measurements for each tissue and ratio. The coefficient of variation (CV) is generally about 10%.

TABLE 6(ii)

Tissue to liver ratios after single intravenous administration of $^{35}$S-labelled Compound 3205 (SEQ ID NO: 2) in female pigmented mice.
$^{35}$S-Compound 3205 (SEQ ID NO: 2)

| Animal no | 10 | 11 | 12 | 13 | 14 | 15 | 16 | 17 | 18 |
|---|---|---|---|---|---|---|---|---|---|
| Surv. Time (h) | 0.083 | 0.25 | 1 h | 4 h | 24 h | 48 h | 96 h | 168 | 504 |
| Organ | | | | | | | | | |
| Adrenal gl | liver | liver | liver | liver | liver | liver | liver | liver | liver |
| Bile | 1.15 | 1.08 | 0.52 | 0.27 | 0.24 | 0.26 | 0.23 | 0.18 | 0.17 |
| Bone marrow | 0.03 | 0.11 | 0.55 | 0.10 | 0.03 | 0.07 | 0.04 | 0.03 | 0.04 |
| Brain | 0.61 | 0.81 | 0.55 | 0.45 | 0.40 | 0.48 | 0.43 | 0.42 | 0.34 |
| Brown fat | 0.03 | 0.03 | 0.01 | 0.00 | 0.00 | 0.00 | 0.00 | 0.00 | 0.00 |
| Gastric muc | 0.75 | 0.57 | 0.29 | 0.12 | 0.07 | 0.12 | 0.08 | 0.10 | 0.07 |
| Heart blood | 0.86 | 0.71 | 0.31 | 0.22 | 0.10 | 0.21 | 0.15 | 0.16 | 0.12 |
| Kidney ctx | 2.23 | 1.91 | 0.74 | 0.11 | 0.01 | 0.00 | 0.00 | 0.00 | 0.00 |
| Liver | 2.87 | 3.94 | 6.45 | 6.95 | 5.51 | 6.68 | 3.92 | 2.24 | 0.40 |
| Lung | 1.00 | 1.00 | 1.00 | 1.00 | 1.00 | 1.00 | 1.00 | 1.00 | 1.00 |
| Lymph node | 1.12 | 0.97 | 0.63 | 0.09 | 0.04 | 0.04 | 0.03 | 0.02 | 0.02 |
| Lymph | 0.43 | 0.30 | 0.25 | 0.19 | 0.11 | 0.32 | 0.20 | 0.17 | 0.12 |
| Myocardium | 0.82 | 1.09 | 1.78 | 2.78 | 1.03 | 2.05 | 1.62 | 3.17 | 1.89 |
| Ovary | 0.69 | 0.63 | 0.30 | 0.13 | 0.10 | 0.15 | 0.09 | 0.11 | 0.12 |
| Pancreas | 1.10 | 1.40 | 0.61 | 0.31 | 0.27 | 0.28 | 0.21 | 0.21 | 0.08 |
| Pituitary gland | 0.42 | 0.37 | 0.22 | 0.18 | 0.12 | 0.17 | 0.12 | 0.15 | 0.11 |
| Salivary gland | 0.57 | 0.54 | 0.28 | 0.11 | 0.15 | 0.16 | 0.12 | 0.10 | 0.08 |
| Skel. muscle | 0.73 | 0.81 | 0.38 | 0.25 | 0.25 | 0.42 | 0.23 | 0.85 | 0.24 |
| Skin. pigm. | 0.40 | 0.28 | 0.14 | 0.04 | 0.02 | 0.04 | 0.03 | 0.03 | 0.03 |
| Spleen | 0.34 | 0.69 | 0.65 | 0.36 | 0.20 | 0.26 | 0.20 | 0.19 | 0.13 |
| Thymus | 0.83 | 0.86 | 0.44 | 0.32 | 0.24 | 0.34 | 0.35 | 0.29 | 0.31 |
| Thyroid gland | 0.32 | 0.31 | 0.14 | 0.07 | 0.09 | 0.08 | 0.05 | 0.04 | 0.02 |
| Urine | 0.9 | 1.2 | 0.43 | 0.28 | 0.25 | 0.34 | 0.19 | 0.26 | 0.25 |

TABLE 6(ii)-continued

Tissue to liver ratios after single intravenous administration of
$^{35}$S-labelled Compound 3205 (SEQ ID NO: 2) in female pigmented mice.

$^{35}$S-Compound 3205 (SEQ ID NO: 2)

| Animal no | 10 | 11 | 12 | 13 | 14 | 15 | 16 | 17 | 18 |
|---|---|---|---|---|---|---|---|---|---|
| Uterus | 27.96 | 39.48 | 9.90 | 5.44 | 0.24 | 0.39 | 0.12 | 0.15 | 0.03 |
| Uvea of the eye | 0.56 | 1.23 | 0.65 | 0.30 | 0.30 | 0.07 | 0.27 | 0.16 | 0.08 |

Conclusions: Compound 3205 (SEQ ID NO: 2) shows blood clearance of radioactivity with elimination half-lives of 8-10 hours. High levels of radioactivity were registered in the kidney cortex, lymph, liver, bone marrow, spleen, ovary and uterus. The highest level of radioactivity was registered in the kidney cortex showing five times higher levels than that of the liver for Compound 3205 (SEQ ID NO: 2). A strong retention of radioactivity was noticed in the kidney cortex, lymph, liver, bone marrow and spleen for Compound 3205 (SEQ ID NO: 2) LNA-antimiR-21.

Materials and Methods:

Dose administration: All mice were weighed before administration. Nine female mice were given 10 mg/kg of $^{35}$S-Compound 3205 (SEQ ID NO: 2) intravenously in a tail vein. The volume given to each animal was 10 mL/kg of the test formulation. The specific activity 75.7 µCi/mg. Individual mice were killed 5 min, 15 min, 1 hour, 4 hours, 24 hours, 2 days, 4 days, 7 days and 21 days after administration of Compound 3205 (SEQ ID NO: 2). Whole body autoradiography: The mice were anaesthetized by sevoflurane, and then immediately immersed in heptane, cooled with dry ice to −80° C., ABR-SOP-0130. The frozen carcasses were embedded in a gel of aqueous carboxymethyl cellulose (CMC), frozen in ethanol, cooled with dry ice (−80° C.) and sectioned sagittaly for whole body autoradiography, according to the standard method, ABR-SOP-0131. From each animal 20 µm sections were cut at different levels with a cryomicrotome (Leica CM 3600) at a temperature of about −20° C. The obtained sections were caught on tape (Minnesota Mining and Manufacturing Co., No. 810) and numbered consecutively with radioactive ink. After being freeze-dried at −20° C. for about 24 hours, selected sections were covered with a thin layer of mylar foil, and put on imaging plates (Fuji, Japan). Exposure took place in light tight cassettes in a lead shielding box at −20° C., to protect the image plates from environmental radiation. After exposure the imaging plates were scanned at a pixel size of 50 µm and analyzed by radioluminography using a bioimaging analysis system (Bas 2500, Fuji, Japan), and described in ABR-SOP-0214. A water-soluble standard test solution of $^{35}$S radioactivity was mixed with whole blood and used for production of a calibration scale, ABR-SOP-0251. However, the different blood standards were dissolved in 500 uL Soluene-35. 4.5 mL Ultima Gold was then added to the dissolved samples. As $^{35}$S and $^{14}$C have very similar energy spectra, a standard $^{14}$C-programme (Packard 2200CA) was used when the radioactivity for the different blood samples was settled.

Pharmacokinetic calculations: The $^{35}$S radioactivity measured in whole blood and tissues was expressed as nCi/g tissue and recalculated to nmol equiv/g tissue for the pharmacokinetic evaluation. The pharmacokinetic parameters $C_{max}$, $t_{1/2}$ and AUC were determined for the whole blood and tissues by non-compartmental analysis using WinNonlin Professional (Pharsight Corporation, Mountain View, Calif., USA). After intravenous administration, the concentration was extrapolated back to zero and expressed as ($C_0$). The elimination rate constant λ was estimated by linear regression analysis of the terminal slope of the logarithmic plasma concentration-time curve. The elimination half-life, $t_{1/2}$, was calculated using the equation, $t_{1/2}$=ln 2/λ. The last three timepoints above LOQ were used in the elimination half-life calculations, if not stated otherwise.

Example 38

Assessment of let-7 Inhibition In Vivo by an 8-mer LNA-AntimiR, as Determined Through Ras Protein Quantification in Mouse Lung and Kidney In order to investigate the possibility to antagonize the abundantly expressed let-7 family in vivo, mice were intravenously (i.v.) injected with an 8-mer LNA-antimiR antagonist or with saline. To measure treatment effect, proteins were isolated from lungs and kidneys. Because the Ras family of proteins (N-Ras, K-Ras, and H-Ras), in particular N-Ras and K-Ras, has previously been shown to be regulated (repressed) by the let-7 family by Johnson et al. (Cell, 2005), the aim was to analyze whether these let-7 targets could be de-repressed in vivo.

Results: As seen in FIG. 37, the 8-mer LNA-antimiR potently de-repressed Ras protein levels in the kidneys of treated mice, normalized against saline controls. The up-regulation in this organ was more than 3-fold, showing a clear in vivo effect. In the lungs, however, only a minimal (1.2-fold) Ras de-repression was observed (FIG. 1B), suggesting that insufficient amounts of LNA-antimiR has entered this organ in order to inhibit its massive amounts of let-7, as previously described by Johnson et al. (Cancer Research, 2007).

Conclusion: The 8-mer LNA-antimiR shows a clear effect in regulating target let-7 miRNA in vivo, as evaluated based on Ras protein levels in treated vs. control mice. Whereas the effect seems to be smaller in lungs, Ras levels in the kidney show a substantial up-regulation upon antimiRs-treatment.

Materials and Methods: Animals and dosing: C57BL/6 female mice were treated with 10 mg/kg LNA-antimiR or saline for three consecutive days (0, 1, and 2) and sacrificed on day 4. Tissue samples from lungs and kidneys were snap-frozen and stored at −80° C. until further processing.

Western blot analysis: Lung and kidney proteins from saline and LNA-antimiR-treated mice were separated on NuPAGE Bis Tris 4-12% (Invitrogen), using 100 µg per sample. The proteins were transferred to a nitrocellulose membrane using iBlot (Invitrogen) according to the manufacturer's instructions. Blocking, antibody dilution and detection was performed according to the manufacturer's specifications. For Ras detection, a primary rabbit-anti Ras antibody (SC-3339, Santa Cruz Biotechnology) and a secondary HRP-conjugated swine-anti-rabbit antibody (P0399, Dako) was used, and for tubulin detection, a primary tubulin alpha (MS-581-P1, Neomarkers) and a secondary HRP-conjugated goat-anti-mouse antibody (P0447, Dako) was used.

Example 40

In Vivo Efficacy Assessment of the 8-mer LNA-AntimiR (Compound 3205, SEQ ID NO: 2) in Targeting miR-21, as Determined by Pdcd4 Protein Up-Regulation in Mouse Kidney We have shown that an 8-mer LNA-antimiR that is fully LNA-modified antagonizes miR-21 and has the ability to regulate the protein levels of the miR-21 target Pdcd4 in vitro. We therefore injected the LNA-antimiR into mice to determine the effects of the LNA-antimiR in vivo. The mice received 25 mg/kg of Compound 3205 (SEQ ID NO: 2) by i.v. injection every other day for 14 days (a total of 5 doses). The mice were sacrificed on day 14, the kidney was removed, and protein was isolated. In order to determine target regulation, Western blot analysis was performed.

Results: As shown in FIG. 38, treating mice with Compound 3205 (SEQ ID NO: 2) showed significantly increased Pdcd4 protein levels as compared to the saline control. While the normalized Pdcd4 versus Gapdh ratio was consistent in both saline samples, the protein up-regulation in the two LNA-antimiR-treated with Compound 3205 (SEQ ID NO: 2) mice were measured to 3.3- and 6.3-fold, respectively, demonstrating an in vivo pharmacological effect of the Compound 3205 (SEQ ID NO: 2) 8-mer LNA-antimiR.

Conclusion: The fully LNA-modified 8-mer LNA-antimiR Compound 3205 (SEQ ID NO: 2) antagonizes miR-21 in vivo, as demonstrated through its ability to de-repress (up-regulate) mouse kidney levels of Pdcd4, a validated miR-21 target.

Materials and Methods:

Animals and dosing: C57BL/6 female mice with average of 20 g body weight at first dosing were used in all experiments and received regular chow diet (Altromin no 1324, Brogaarden, Gentofte, Denmark). Substances were formulated in physiological saline (0.9% NaCl). The animals were dozed with LNA-antimiR or saline (0.9% NaCl), receiving an injection of 25 mg/kg every other day for 14 days, a total of 5 doses. Animals were sacrificed on day 14.

Western blot analysis: 80 μg kidney tissue from saline or LNA-treated mice was separated on NuPAGE Bis Tris 4-12% (Invitrogen). The proteins were transferred to a nitrocellulose membrane using iBlot (Invitrogen) according to the manufacturer's instructions. The membrane was incubated with Pdcd4 antibody (Bethyl Laboratories), followed by HRP-conjugated swine-anti-rabbit antibody (Dako). As equal loading control, GAPDH (Abcam) was used, followed by HRP-conjugated swine-anti-mouse antibody. The membranes were visualized by chemiluminiscence (ECL, Amersham).

| microRNA | MicroRNASequence | SEQ ID NO | 9-mer Compound | 8-mer Compound | 7-mer Compound |
|---|---|---|---|---|---|
| ebv-miR-BART1-3p | UAGCACCGCUAUCCACUAUGUC | 40 | AGCGGTGCT | GCGGTGCT | CGGTGCT |
| ebv-miR-BART1-5p | UCUUAGUGGAAGUGACGUGCUGUG | 41 | TCCACTAAG | CCACTAAG | CACTAAG |
| ebv-miR-BART10 | UACAUAACCAUGGAGUUGGCUGU | 42 | TGGTTATGT | GGTTATGT | GTTATGT |
| ebv-miR-BART10* | GCCACCUCUUUGGUUCUGUACA | 43 | AAGAGGTGG | AGAGGTGG | GAGGTGG |
| ebv-miR-BART11-3p | ACGCACACCAGGCUGACUGCC | 44 | TGGTGTGCG | GGTGTGCG | GTGTGCG |
| ebv-miR-BART11-5p | UCAGACAGUUUGGUGCGCUAGUUG | 45 | AACTGTCTG | ACTGTCTG | CTGTCTG |
| ebv-miR-BART12 | UCCUGUGGUGUUUGGUGUGGUU | 46 | CACCACAGG | ACCACAGG | CCACAGG |
| ebv-miR-BART13 | UGUAACUUGCCAGGGACGGCUGA | 47 | GCAAGTTAC | CAAGTTAC | AAGTTAC |
| ebv-miR-BART13* | AACCGGCUCGUGGCUCGUACAG | 48 | CGAGCCGGT | GAGCCGGT | AGCCGGT |
| ebv-miR-BART14 | UAAAUGCUGCAGUAGUAGGGAU | 49 | GCAGCATTT | CAGCATTT | AGCATTT |
| ebv-miR-BART14* | UACCCUACGCUGCCGAUUUACA | 50 | GCGTAGGGT | CGTAGGGT | GTAGGGT |
| ebv-miR-BART15 | GUCAGUGGUUUUGUUUCCUUGA | 51 | AACCACTGA | ACCACTGA | CCACTGA |
| ebv-miR-BART16 | UUAGAUAGAGUGGGUGUGUGCUCU | 52 | CTCTATCTA | TCTATCTA | CTATCTA |
| ebv-miR-BART17-3p | UGUAUGCCUGGUGUCCCCUUAGU | 53 | CAGGCATAC | AGGCATAC | GGCATAC |
| ebv-miR-BART17-5p | UAAGAGGACGCAGGCAUACAAG | 54 | CGTCCTCTT | GTCCTCTT | TCCTCTT |
| ebv-miR-BART18-3p | UAUCGGAAGUUUGGGCUUCGUC | 55 | ACTTCCGAT | CTTCCGAT | TTCCGAT |
| ebv-miR-BART18-5p | UCAAGUUCGCACUUCCUAUACA | 56 | GCGAACTTG | CGAACTTG | GAACTTG |
| ebv-miR-BART19-3p | UUUUGUUUGCUUGGGAAUGCU | 57 | GCAAACAAA | CAAACAAA | AAACAAA |
| ebv-miR-BART19-5p | ACAUUCCCCGCAAACAUGACAUG | 58 | CGGGGAATG | GGGGAATG | GGGAATG |
| ebv-miR-BART2-3p | AAGGAGCGAUUUGGAGAAAAUAAA | 59 | ATCGCTCCT | TCGCTCCT | CGCTCCT |
| ebv-miR-BART2-5p | UAUUUUCUGCAUUCGCCCUUGC | 60 | GCAGAAAAT | CAGAAAAT | AGAAAAT |
| ebv-miR-BART20-3p | CAUGAAGGCACAGCCUGUUACC | 61 | TGCCTTCAT | GCCTTCAT | CCTTCAT |

-continued

| microRNA | MicroRNASequence | SEQ ID NO | 9-mer Compound | 8-mer Compound | 7-mer Compound |
|---|---|---|---|---|---|
| ebv-miR-BART20-5p | UAGCAGGCAUGUCUUCAUUCC | 62 | ATGCCTGCT | TGCCTGCT | GCCTGCT |
| ebv-miR-BART3 | CGCACCACUAGUCACCAGGUGU | 63 | TAGTGGTGC | AGTGGTGC | GTGGTGC |
| ebv-miR-BART3* | ACCUAGUGUUAGUGUUGUGCU | 64 | AACACTAGG | ACACTAGG | CACTAGG |
| ebv-miR-BART4 | GACCUGAUGCUGCUGGUGUGCU | 65 | GCATCAGGT | CATCAGGT | ATCAGGT |
| ebv-miR-BART5 | CAAGGUGAAUAUAGCUGCCCAUCG | 66 | ATTCACCTT | TTCACCTT | TCACCTT |
| ebv-miR-BART6-3p | CGGGGAUCGGACUAGCCUUAGA | 67 | CCGATCCCC | CGATCCCC | GATCCCC |
| ebv-miR-BART6-5p | UAAGGUUGGUCCAAUCCAUAGG | 68 | ACCAACCTT | CCAACCTT | CAACCTT |
| ebv-miR-BART7 | CAUCAUAGUCCAGUGUCCAGGG | 69 | GACTATGAT | ACTATGAT | CTATGAT |
| ebv-miR-BART7* | CCUGGACCUUGACUAUGAAACA | 70 | AAGGTCCAG | AGGTCCAG | GGTCCAG |
| ebv-miR-BART8 | UACGGUUUCCUAGAUUGUACAG | 71 | GGAAACCGT | GAAACCGT | AAACCGT |
| ebv-miR-BART8* | GUCACAAUCUAUGGGGUCGUAGA | 72 | AGATTGTGA | GATTGTGA | ATTGTGA |
| ebv-miR-BART9 | UAACACUUCAUGGGUCCCGUAGU | 73 | TGAAGTGTT | GAAGTGTT | AAGTGTT |
| ebv-miR-BART9* | UACUGGACCCUGAAUUGGAAAC | 74 | GGGTCCAGT | GGTCCAGT | GTCCAGT |
| ebv-miR-BHRF1-1 | UAACCUGAUCAGCCCCGGAGUU | 75 | GATCAGGTT | ATCAGGTT | TCAGGTT |
| ebv-miR-BHRF1-2 | UAUCUUUUGCGGCAGAAAUUGA | 76 | GCAAAAGAT | CAAAAGAT | AAAAGAT |
| ebv-miR-BHRF1-2* | AAAUUCUGUUGCAGCAGAUAGC | 77 | AACAGAATT | ACAGAATT | CAGAATT |
| ebv-miR-BHRF1-3 | UAACGGGAAGUGUGUAAGCACA | 78 | CTTCCCGTT | TTCCCGTT | TCCCGTT |
| hcmv-miR-UL112 | AAGUGACGGUGAGAUCCAGGCU | 79 | ACCGTCACT | CCGTCACT | CGTCACT |
| hcmv-miR-UL148D | UCGUCCUCCCCUUCUUCACCG | 80 | GGGAGGACG | GGAGGACG | GAGGACG |
| hcmv-miR-UL22A | UAACUAGCCUUCCCGUGAGA | 81 | AGGCTAGTT | GGCTAGTT | GCTAGTT |
| hcmv-miR-UL22A* | UCACCAGAAUGCUAGUUUGUAG | 82 | ATTCTGGTG | TTCTGGTG | TCTGGTG |
| hcmv-miR-UL36 | UCGUUGAAGACACCUGGAAAGA | 83 | TCTTCAACG | CTTCAACG | TTCAACG |
| hcmv-miR-UL36* | UUUCCAGGUGUUUUCAACGUGC | 84 | CACCTGGAA | ACCTGGAA | CCTGGAA |
| hcmv-miR-UL70-3p | GGGGAUGGGCUGGCGCGCGG | 85 | GCCCATCCC | CCCATCCC | CCATCCC |
| hcmv-miR-UL70-5p | UGCGUCUCGGCCUCGUCCAGA | 86 | CCGAGACGC | CGAGACGC | GAGACGC |
| hcmv-miR-US25-1 | AACCGCUCAGUGGCUCGGACC | 87 | CTGAGCGGT | TGAGCGGT | GAGCGGT |
| hcmv-miR-US25-1* | UCCGAACGCUAGGUCGGUUCUC | 88 | AGCGTTCGG | GCGTTCGG | CGTTCGG |
| hcmv-miR-US25-2-3p | AUCCACUUGGAGAGCUCCCGCGG | 89 | CCAAGTGGA | CAAGTGGA | AAGTGGA |
| hcmv-miR-US25-2-5p | AGCGGUCUGUUCAGGUGGAUGA | 90 | ACAGACCGC | CAGACCGC | AGACCGC |
| hcmv-miR-US33-3p | UCACGGUCCGAGCACAUCCA | 91 | CGGACCGTG | GGACCGTG | GACCGTG |
| hcmv-miR-US33-5p | GAUUGUGCCCGGACCGUGGGCG | 92 | GGGCACAAT | GGCACAAT | GCACAAT |
| hcmv-miR-US4 | CGACAUGGACGUGCAGGGGAU | 93 | GTCCATGTC | TCCATGTC | CCATGTC |
| hcmv-miR-US5-1 | UGACAAGCCUGACGAGAGCGU | 94 | AGGCTTGTC | GGCTTGTC | GCTTGTC |
| hcmv-miR-US5-2 | UUAUGAUAGGUGUGACGAUGUC | 95 | CCTATCATA | CTATCATA | TATCATA |
| hsa-let-7a | UGAGGUAGUAGGUUGUAUAGUU | 96 | TACTACCTC | ACTACCTC | CTACCTC |
| hsa-let-7a* | CUAUACAAUCUACUGUCUUUC | 97 | GATTGTATA | ATTGTATA | TTGTATA |
| hsa-let-7b | UGAGGUAGUAGGUUGUGUGGUU | 98 | TACTACCTC | ACTACCTC | CTACCTC |

-continued

| microRNA | MicroRNASequence | SEQ ID NO | 9-mer Compound | 8-mer Compound | 7-mer Compound |
|---|---|---|---|---|---|
| hsa-let-7b* | CUAUACAACCUACUGCCUUCCC | 99 | GGTTGTATA | GTTGTATA | TTGTATA |
| hsa-let-7c | UGAGGUAGUAGGUUGUAUGGUU | 100 | TACTACCTC | ACTACCTC | CTACCTC |
| hsa-let-7c* | UAGAGUUACACCCUGGGAGUUA | 101 | TGTAACTCT | GTAACTCT | TAACTCT |
| hsa-let-7d | AGAGGUAGUAGGUUGCAUAGUU | 102 | TACTACCTC | ACTACCTC | CTACCTC |
| hsa-let-7d* | CUAUACGACCUGCUGCCUUUCU | 103 | GGTCGTATA | GTCGTATA | TCGTATA |
| hsa-let-7e | UGAGGUAGGAGGUUGUAUAGUU | 104 | TCCTACCTC | CCTACCTC | CTACCTC |
| hsa-let-7e* | CUAUACGGCCUCCUAGCUUUCC | 105 | GGCCGTATA | GCCGTATA | CCGTATA |
| hsa-let-7f | UGAGGUAGUAGAUUGUAUAGUU | 106 | TACTACCTC | ACTACCTC | CTACCTC |
| hsa-let-7f-1* | CUAUACAAUCUAUUGCCUUCCC | 107 | GATTGTATA | ATTGTATA | TTGTATA |
| hsa-let-7f-2* | CUAUACAGUCUACUGUCUUUCC | 108 | GACTGTATA | ACTGTATA | CTGTATA |
| hsa-let-7g | UGAGGUAGUAGUUUGUACAGUU | 109 | TACTACCTC | ACTACCTC | CTACCTC |
| hsa-let-7g* | CUGUACAGGCCACUGCCUUGC | 110 | GCCTGTACA | CCTGTACA | CTGTACA |
| hsa-let-7i | UGAGGUAGUAGUUUGUGCUGUU | 111 | TACTACCTC | ACTACCTC | CTACCTC |
| hsa-let-7i* | CUGCGCAAGCUACUGCCUUGCU | 112 | GCTTGCGCA | CTTGCGCA | TTGCGCA |
| hsa-miR-1 | UGGAAUGUAAAGAAGUAUGUAU | 113 | TTACATTCC | TACATTCC | ACATTCC |
| hsa-miR-100 | AACCCGUAGAUCCGAACUUGUG | 114 | TCTACGGGT | CTACGGGT | TACGGGT |
| hsa-miR-100* | CAAGCUUGUAUCUAUAGGUAUG | 115 | TACAAGCTT | ACAAGCTT | CAAGCTT |
| hsa-miR-101 | UACAGUACUGUGAUAACUGAA | 116 | CAGTACTGT | AGTACTGT | GTACTGT |
| hsa-miR-101* | CAGUUAUCACAGUGCUGAUGCU | 117 | GTGATAACT | TGATAACT | GATAACT |
| hsa-miR-103 | AGCAGCAUUGUACAGGGCUAUGA | 118 | CAATGCTGC | AATGCTGC | ATGCTGC |
| hsa-miR-103-as | UCAUAGCCCUGUACAAUGCUGCU | 119 | AGGGCTATG | GGGCTATG | GGCTATG |
| hsa-miR-105 | UCAAAUGCUCAGACUCCUGUGGU | 120 | GAGCATTTG | AGCATTTG | GCATTTG |
| hsa-miR-105* | ACGGAUGUUUGAGCAUGUGCUA | 121 | AAACATCCG | AACATCCG | ACATCCG |
| hsa-miR-106a | AAAAGUGCUUACAGUGCAGGUAG | 122 | AAGCACTTT | AGCACTTT | GCACTTT |
| hsa-miR-106a* | CUGCAAUGUAAGCACUUCUUAC | 123 | TACATTGCA | ACATTGCA | CATTGCA |
| hsa-miR-106b | UAAAGUGCUGACAGUGCAGAU | 124 | CAGCACTTT | AGCACTTT | GCACTTT |
| hsa-miR-106b* | CCGCACUGUGGGUACUUGCUGC | 125 | CACAGTGCG | ACAGTGCG | CAGTGCG |
| hsa-miR-107 | AGCAGCAUUGUACAGGGCUAUCA | 126 | CAATGCTGC | AATGCTGC | ATGCTGC |
| hsa-miR-10a | UACCCUGUAGAUCCGAAUUUGUG | 127 | CTACAGGGT | TACAGGGT | ACAGGGT |
| hsa-miR-10a* | CAAAUUCGUAUCUAGGGGAAUA | 128 | TACGAATTT | ACGAATTT | CGAATTT |
| hsa-miR-10b | UACCCUGUAGAACCGAAUUUGUG | 129 | CTACAGGGT | TACAGGGT | ACAGGGT |
| hsa-miR-10b* | ACAGAUUCGAUUCUAGGGGAAU | 130 | TCGAATCTG | CGAATCTG | GAATCTG |
| hsa-miR-1178 | UUGCUCACUGUUCUUCCCUAG | 131 | CAGTGAGCA | AGTGAGCA | GTGAGCA |
| hsa-miR-1179 | AAGCAUUCUUUCAUUGGUUGG | 132 | AAGAATGCT | AGAATGCT | GAATGCT |
| hsa-miR-1180 | UUUCCGGCUCGCGUGGGUGUGU | 133 | GAGCCGGAA | AGCCGGAA | GCCGGAA |
| hsa-miR-1181 | CCGUCGCCGCCACCCGAGCCG | 134 | GCGGCGACG | CGGCGACG | GGCGACG |
| hsa-miR-1182 | GAGGGUCUUGGGAGGGAUGUGAC | 135 | CAAGACCCT | AAGACCCT | AGACCCT |
| hsa-miR-1183 | CACUGUAGGUGAUGGUGAGAGUGGGCA | 136 | ACCTACAGT | CCTACAGT | CTACAGT |

-continued

| microRNA | MicroRNASequence | SEQ ID NO | 9-mer Compound | 8-mer Compound | 7-mer Compound |
|---|---|---|---|---|---|
| hsa-miR-1184 | CCUGCAGCGACUUGAUGGCUUCC | 137 | TCGCTGCAG | CGCTGCAG | GCTGCAG |
| hsa-miR-1185 | AGAGGAUACCCUUUGUAUGUU | 138 | GGTATCCTC | GTATCCTC | TATCCTC |
| hsa-miR-1197 | UAGGACACAUGGUCUACUUCU | 139 | ATGTGTCCT | TGTGTCCT | GTGTCCT |
| hsa-miR-1200 | CUCCUGAGCCAUUCUGAGCCUC | 140 | GGCTCAGGA | GCTCAGGA | CTCAGGA |
| hsa-miR-1201 | AGCCUGAUUAAACACAUGCUCUGA | 141 | TAATCAGGC | AATCAGGC | ATCAGGC |
| hsa-miR-1202 | GUGCCAGCUGCAGUGGGGAG | 142 | CAGCTGGCA | AGCTGGCA | GCTGGCA |
| hsa-miR-1203 | CCCGGAGCCAGGAUGCAGCUC | 143 | TGGCTCCGG | GGCTCCGG | GCTCCGG |
| hsa-miR-1204 | UCGUGGCCUGGUCUCCAUUAU | 144 | CAGGCCACG | AGGCCACG | GGCCACG |
| hsa-miR-1205 | UCUGCAGGGUUUGCUUUGAG | 145 | ACCCTGCAG | CCCTGCAG | CCTGCAG |
| hsa-miR-1206 | UGUUCAUGUAGAUGUUUAAGC | 146 | TACATGAAC | ACATGAAC | CATGAAC |
| hsa-miR-1207-3p | UCAGCUGGCCCUCAUUUC | 147 | GGCCAGCTG | GCCAGCTG | CCAGCTG |
| hsa-miR-1207-5p | UGGCAGGGAGGCUGGGAGGGG | 148 | CTCCCTGCC | TCCCTGCC | CCCTGCC |
| hsa-miR-1208 | UCACUGUUCAGACAGGCGGA | 149 | TGAACAGTG | GAACAGTG | AACAGTG |
| hsa-miR-122 | UGGAGUGUGACAAUGGUGUUUG | 150 | TCACACTCC | CACACTCC | ACACTCC |
| hsa-miR-122* | AACGCCAUUAUCACACUAAAUA | 151 | TAATGGCGT | AATGGCGT | ATGGCGT |
| hsa-miR-1224-3p | CCCCACCUCCUCUCUCCUCAG | 152 | GGAGGTGGG | GAGGTGGG | AGGTGGG |
| hsa-miR-1224-5p | GUGAGGACUCGGGAGGUGG | 153 | GAGTCCTCA | AGTCCTCA | GTCCTCA |
| hsa-miR-1225-3p | UGAGCCCCUGUGCCGCCCCCAG | 154 | CAGGGGCTC | AGGGGCTC | GGGGCTC |
| hsa-miR-1225-5p | GUGGGUACGGCCCAGUGGGGGG | 155 | CCGTACCCA | CGTACCCA | GTACCCA |
| hsa-miR-1226 | UCACCAGCCCUGUGUUCCCUAG | 156 | GGGCTGGTG | GGCTGGTG | GCTGGTG |
| hsa-miR-1226* | GUGAGGGCAUGCAGGCCUGGAUGGGG | 157 | ATGCCCTCA | TGCCCTCA | GCCCTCA |
| hsa-miR-1227 | CGUGCCACCCUUUUCCCCAG | 158 | GGGTGGCAC | GGTGGCAC | GTGGCAC |
| hsa-miR-1228 | UCACACCUGCCUCGCCCCCC | 159 | GCAGGTGTG | CAGGTGTG | AGGTGTG |
| hsa-miR-1228* | GUGGGCGGGGGCAGGUGUGUG | 160 | CCCCGCCCA | CCCGCCCA | CCGCCCA |
| hsa-miR-1229 | CUCUCACCACUGCCCUCCCACAG | 161 | GTGGTGAGA | TGGTGAGA | GGTGAGA |
| hsa-miR-1231 | GUGUCUGGGCGGACAGCUGC | 162 | GCCCAGACA | CCCAGACA | CCAGACA |
| hsa-miR-1233 | UGAGCCCUGUCCUCCCGCAG | 163 | ACAGGGCTC | CAGGGCTC | AGGGCTC |
| hsa-miR-1234 | UCGGCCUGACCACCCACCCCAC | 164 | GTCAGGCCG | TCAGGCCG | CAGGCCG |
| hsa-miR-1236 | CCUCUUCCCCUUGUCUCUCCAG | 165 | GGGGAAGAG | GGGAAGAG | GGAAGAG |
| hsa-miR-1237 | UCCUUCUGCUCCGUCCCCCAG | 166 | AGCAGAAGG | GCAGAAGG | CAGAAGG |
| hsa-miR-1238 | CUUCCUCGUCUGUCUGCCCC | 167 | GACGAGGAA | ACGAGGAA | CGAGGAA |
| hsa-miR-124 | UAAGGCACGCGGUGAAUGCC | 168 | GCGTGCCTT | CGTGCCTT | GTGCCTT |
| hsa-miR-124* | CGUGUUCACAGCGGACCUUGAU | 169 | TGTGAACAC | GTGAACAC | TGAACAC |
| hsa-miR-1243 | AACUGGAUCAAUUAUAGGAGUG | 170 | TGATCCAGT | GATCCAGT | ATCCAGT |
| hsa-miR-1244 | AAGUAGUUGGUUUGUAUGAGAUGGUU | 171 | CCAACTACT | CAACTACT | AACTACT |
| hsa-miR-1245 | AAGUGAUCUAAAGGCCUACAU | 172 | TAGATCACT | AGATCACT | GATCACT |
| hsa-miR-1246 | AAUGGAUUUUUGGAGCAGG | 173 | AAAATCCAT | AAATCCAT | AATCCAT |
| hsa-miR-1247 | ACCCGUCCCGUUCGUCCCCGGA | 174 | CGGGACGGG | GGGACGGG | GGACGGG |

-continued

| microRNA | MicroRNASequence | SEQ ID NO | 9-mer Compound | 8-mer Compound | 7-mer Compound |
|---|---|---|---|---|---|
| hsa-miR-1248 | ACCUUCUUGUAUAAGCACUGUGCUAAA | 175 | ACAAGAAGG | CAAGAAGG | AAGAAGG |
| hsa-miR-1249 | ACGCCCUUCCCCCCCUUCUUCA | 176 | GGAAGGGCG | GAAGGGCG | AAGGGCG |
| hsa-miR-1250 | ACGGUGCUGGAUGUGGCCUUU | 177 | CCAGCACCG | CAGCACCG | AGCACCG |
| hsa-miR-1251 | ACUCUAGCUGCCAAAGGCGCU | 178 | CAGCTAGAG | AGCTAGAG | GCTAGAG |
| hsa-miR-1252 | AGAAGGAAAUUGAAUUCAUUUA | 179 | ATTTCCTTC | TTTCCTTC | TTCCTTC |
| hsa-miR-1253 | AGAGAAGAAGAUCAGCCUGCA | 180 | CTTCTTCTC | TTCTTCTC | TCTTCTC |
| hsa-miR-1254 | AGCCUGGAAGCUGGAGCCUGCAGU | 181 | CTTCCAGGC | TTCCAGGC | TCCAGGC |
| hsa-miR-1255a | AGGAUGAGCAAAGAAAGUAGAUU | 182 | TGCTCATCC | GCTCATCC | CTCATCC |
| hsa-miR-1255b | CGGAUGAGCAAAGAAAGUGGUU | 183 | TGCTCATCC | GCTCATCC | CTCATCC |
| hsa-miR-1256 | AGGCAUUGACUUCUCACUAGCU | 184 | GTCAATGCC | TCAATGCC | CAATGCC |
| hsa-miR-1257 | AGUGAAUGAUGGGUUCUGACC | 185 | ATCATTCAC | TCATTCAC | CATTCAC |
| hsa-miR-1258 | AGUUAGGAUUAGGUCGUGGAA | 186 | AATCCTAAC | ATCCTAAC | TCCTAAC |
| hsa-miR-1259 | AUAUAUGAUGACUUAGCUUUU | 187 | CATCATATA | ATCATATA | TCATATA |
| hsa-miR-125a-3p | ACAGGUGAGGUUCUUGGGAGCC | 188 | CCTCACCTG | CTCACCTG | TCACCTG |
| hsa-miR-125a-5p | UCCCUGAGACCCUUUAACCUGUGA | 189 | GTCTCAGGG | TCTCAGGG | CTCAGGG |
| hsa-miR-125b | UCCCUGAGACCCUAACUUGUGA | 190 | GTCTCAGGG | TCTCAGGG | CTCAGGG |
| hsa-miR-125b-1* | ACGGGUUAGGCUCUUGGGAGCU | 191 | CCTAACCCG | CTAACCCG | TAACCCG |
| hsa-miR-125b-2* | UCACAAGUCAGGCUCUUGGGAC | 192 | TGACTTGTG | GACTTGTG | ACTTGTG |
| hsa-miR-126 | UCGUACCGUGAGUAAUAAUGCG | 193 | CACGGTACG | ACGGTACG | CGGTACG |
| hsa-miR-126* | CAUUAUUACUUUUGGUACGCG | 194 | AGTAATAAT | GTAATAAT | TAATAAT |
| hsa-miR-1260 | AUCCCACCUCUGCCACCA | 195 | GAGGTGGGA | AGGTGGGA | GGTGGGA |
| hsa-miR-1261 | AUGGAUAAGGCUUUGGCUU | 196 | CCTTATCCA | CTTATCCA | TTATCCA |
| hsa-miR-1262 | AUGGGUGAAUUUGUAGAAGGAU | 197 | ATTCACCCA | TTCACCCA | TCACCCA |
| hsa-miR-1263 | AUGGUACCCUGGCAUACUGAGU | 198 | AGGGTACCA | GGGTACCA | GGTACCA |
| hsa-miR-1264 | CAAGUCUUAUUUGAGCACCUGUU | 199 | ATAAGACTT | TAAGACTT | AAGACTT |
| hsa-miR-1265 | CAGGAUGUGGUCAAGUGUUGUU | 200 | CCACATCCT | CACATCCT | ACATCCT |
| hsa-miR-1266 | CCUCAGGGCUGUAGAACAGGGCU | 201 | AGCCCTGAG | GCCCTGAG | CCCTGAG |
| hsa-miR-1267 | CCUGUUGAAGUGUAAUCCCCA | 202 | CTTCAACAG | TTCAACAG | TCAACAG |
| hsa-miR-1268 | CGGGCGUGGUGGUGGGGG | 203 | ACCACGCCC | CCACGCCC | CACGCCC |
| hsa-miR-1269 | CUGGACUGAGCCGUGCUACUGG | 204 | CTCAGTCCA | TCAGTCCA | CAGTCCA |
| hsa-miR-127-3p | UCGGAUCCGUCUGAGCUUGGCU | 205 | ACGGATCCG | CGGATCCG | GGATCCG |
| hsa-miR-127-5p | CUGAAGCUCAGAGGGCUCUGAU | 206 | TGAGCTTCA | GAGCTTCA | AGCTTCA |
| hsa-miR-1270 | CUGGAGAUAUGGAAGAGCUGUGU | 207 | ATATCTCCA | TATCTCCA | ATCTCCA |
| hsa-miR-1271 | CUUGGCACCUAGCAAGCACUCA | 208 | AGGTGCCAA | GGTGCCAA | GTGCCAA |
| hsa-miR-1272 | GAUGAUGAUGGCAGCAAAUUCUGAAA | 209 | CATCATCAT | ATCATCAT | TCATCAT |
| hsa-miR-1273 | GGGCGACAAAGCAAGACUCUUUCUU | 210 | TTTGTCGCC | TTGTCGCC | TGTCGCC |
| hsa-miR-1274a | GUCCCUGUUCAGGCGCCA | 211 | GAACAGGGA | AACAGGGA | ACAGGGA |
| hsa-miR-1274b | UCCCUGUUCGGGCGCCA | 212 | CGAACAGGG | GAACAGGG | AACAGGG |

-continued

| microRNA | MicroRNASequence | SEQ ID NO | 9-mer Compound | 8-mer Compound | 7-mer Compound |
|---|---|---|---|---|---|
| hsa-miR-1275 | GUGGGGGAGAGGCUGUC | 213 | TCTCCCCCA | CTCCCCCA | TCCCCCA |
| hsa-miR-1276 | UAAAGAGCCCUGUGGAGACA | 214 | GGGCTCTTT | GGCTCTTT | GCTCTTT |
| hsa-miR-1277 | UACGUAGAUAUAUAUGUAUUUU | 215 | TATCTACGT | ATCTACGT | TCTACGT |
| hsa-miR-1278 | UAGUACUGUGCAUAUCAUCUAU | 216 | CACAGTACT | ACAGTACT | CAGTACT |
| hsa-miR-1279 | UCAUAUUGCUUCUUUCU | 217 | AGCAATATG | GCAATATG | CAATATG |
| hsa-miR-128 | UCACAGUGAACCGGUCUCUUU | 218 | TTCACTGTG | TCACTGTG | CACTGTG |
| hsa-miR-1280 | UCCCACCGCUGCCACCC | 219 | AGCGGTGGG | GCGGTGGG | CGGTGGG |
| hsa-miR-1281 | UCGCCUCCUCCUCUCCC | 220 | GAGGAGGCG | AGGAGGCG | GGAGGCG |
| hsa-miR-1282 | UCGUUUGCCUUUUUCUGCUU | 221 | AGGCAAACG | GGCAAACG | GCAAACG |
| hsa-miR-1283 | UCUACAAAGGAAAGCGCUUUCU | 222 | CCTTTGTAG | CTTTGTAG | TTTGTAG |
| hsa-miR-1284 | UCUAUACAGACCCUGGCUUUUC | 223 | TCTGTATAG | CTGTATAG | TGTATAG |
| hsa-miR-1285 | UCUGGGCAACAAAGUGAGACCU | 224 | GTTGCCCAG | TTGCCCAG | TGCCCAG |
| hsa-miR-1286 | UGCAGGACCAAGAUGAGCCCU | 225 | TGGTCCTGC | GGTCCTGC | GTCCTGC |
| hsa-miR-1287 | UGCUGGAUCAGUGGUUCGAGUC | 226 | TGATCCAGC | GATCCAGC | ATCCAGC |
| hsa-miR-1288 | UGGACUGCCCUGAUCUGGAGA | 227 | GGGCAGTCC | GGCAGTCC | GCAGTCC |
| hsa-miR-1289 | UGGAGUCCAGGAAUCUGCAUUUU | 228 | CTGGACTCC | TGGACTCC | GGACTCC |
| hsa-miR-129* | AAGCCCUUACCCCAAAAAGUAU | 229 | GTAAGGGCT | TAAGGGCT | AAGGGCT |
| hsa-miR-129-3p | AAGCCCUUACCCCAAAAAGCAU | 230 | GTAAGGGCT | TAAGGGCT | AAGGGCT |
| hsa-miR-129-5p | CUUUUUGCGGUCUGGGCUUGC | 231 | CCGCAAAAA | CGCAAAAA | GCAAAAA |
| hsa-miR-1290 | UGGAUUUUUGGAUCAGGGA | 232 | CAAAAATCC | AAAAATCC | AAAATCC |
| hsa-miR-1291 | UGGCCCUGACUGAAGACCAGCAGU | 233 | GTCAGGGCC | TCAGGGCC | CAGGGCC |
| hsa-miR-1292 | UGGGAACGGGUUCCGGCAGACGCUG | 234 | CCCGTTCCC | CCGTTCCC | CGTTCCC |
| hsa-miR-1293 | UGGGUGGUCUGGAGAUUUGUGC | 235 | AGACCACCC | GACCACCC | ACCACCC |
| hsa-miR-1294 | UGUGAGGUUGGCAUUGUUGUCU | 236 | CAACCTCAC | AACCTCAC | ACCTCAC |
| hsa-miR-1295 | UUAGGCCGCAGAUCUGGGUGA | 237 | TGCGGCCTA | GCGGCCTA | CGGCCTA |
| hsa-miR-1296 | UUAGGGCCCUGGCUCCAUCUCC | 238 | AGGGCCCTA | GGGCCCTA | GGCCCTA |
| hsa-miR-1297 | UUCAAGUAAUUCAGGUG | 239 | ATTACTTGA | TTACTTGA | TACTTGA |
| hsa-miR-1298 | UUCAUUCGGCUGUCCAGAUGUA | 240 | GCCGAATGA | CCGAATGA | CGAATGA |
| hsa-miR-1299 | UUCUGGAAUUCUGUGUGAGGGA | 241 | AATTCCAGA | ATTCCAGA | TTCCAGA |
| hsa-miR-1300 | UUGAGAAGGAGGCUGCUG | 242 | TCCTTCTCA | CCTTCTCA | CTTCTCA |
| hsa-miR-1301 | UUGCAGCUGCCUGGGAGUGACUUC | 243 | GCAGCTGCA | CAGCTGCA | AGCTGCA |
| hsa-miR-1302 | UUGGGACAUACUUAUGCUAAA | 244 | TATGTCCCA | ATGTCCCA | TGTCCCA |
| hsa-miR-1303 | UUUAGAGACGGGGUCUUGCUCU | 245 | CGTCTCTAA | GTCTCTAA | TCTCTAA |
| hsa-miR-1304 | UUUGAGGCUACAGUGAGAUGUG | 246 | TAGCCTCAA | AGCCTCAA | GCCTCAA |
| hsa-miR-1305 | UUUUCAACUCUAAUGGGAGAGA | 247 | GAGTTGAAA | AGTTGAAA | GTTGAAA |
| hsa-miR-1306 | ACGUUGGCUCUGGUGGUG | 248 | GAGCCAACG | AGCCAACG | GCCAACG |
| hsa-miR-1307 | ACUCGGCGUGGCGUCGGUCGUG | 249 | CACGCCGAG | ACGCCGAG | CGCCGAG |
| hsa-miR-1308 | GCAUGGGUGGUUCAGUGG | 250 | CCACCCATG | CACCCATG | ACCCATG |

-continued

| microRNA | MicroRNASequence | SEQ ID NO | 9-mer Compound | 8-mer Compound | 7-mer Compound |
|---|---|---|---|---|---|
| hsa-miR-130a | CAGUGCAAUGUUAAAGGGCAU | 251 | CATTGCACT | ATTGCACT | TTGCACT |
| hsa-miR-130a* | UUCACAUUGUGCUACUGUCUGC | 252 | ACAATGTGA | CAATGTGA | AATGTGA |
| hsa-miR-130b | CAGUGCAAUGAUGAAAGGGCAU | 253 | CATTGCACT | ATTGCACT | TTGCACT |
| hsa-miR-130b* | ACUCUUUCCCUGUUGCACUAC | 254 | GGGAAAGAG | GGAAAGAG | GAAAGAG |
| hsa-miR-132 | UAACAGUCUACAGCCAUGGUCG | 255 | TAGACTGTT | AGACTGTT | GACTGTT |
| hsa-miR-132* | ACCGUGGCUUUCGAUUGUUACU | 256 | AAGCCACGG | AGCCACGG | GCCACGG |
| hsa-miR-1321 | CAGGGAGGUGAAUGUGAU | 257 | CACCTCCCT | ACCTCCCT | CCTCCCT |
| hsa-miR-1322 | GAUGAUGCUGCUGAUGCUG | 258 | CAGCATCAT | AGCATCAT | GCATCAT |
| hsa-miR-1323 | UCAAAACUGAGGGGCAUUUUCU | 259 | TCAGTTTTG | CAGTTTTG | AGTTTTG |
| hsa-miR-1324 | CCAGACAGAAUUCUAUGCACUUUC | 260 | TTCTGTCTG | TCTGTCTG | CTGTCTG |
| hsa-miR-133a | UUUGGUCCCCUUCAACCAGCUG | 261 | GGGGACCAA | GGGACCAA | GGACCAA |
| hsa-miR-133b | UUUGGUCCCCUUCAACCAGCUA | 262 | GGGGACCAA | GGGACCAA | GGACCAA |
| hsa-miR-134 | UGUGACUGGUUGACCAGAGGGG | 263 | ACCAGTCAC | CCAGTCAC | CAGTCAC |
| hsa-miR-135a | UAUGGCUUUUUAUUCCUAUGUGA | 264 | AAAAGCCAT | AAAGCCAT | AAGCCAT |
| hsa-miR-135a* | UAUAGGGAUUGGAGCCGUGGCG | 265 | AATCCCTAT | ATCCCTAT | TCCCTAT |
| hsa-miR-135b | UAUGGCUUUUCAUUCCUAUGUGA | 266 | AAAAGCCAT | AAAGCCAT | AAGCCAT |
| hsa-miR-135b* | AUGUAGGGCUAAAAGCCAUGGG | 267 | AGCCCTACA | GCCCTACA | CCCTACA |
| hsa-miR-136 | ACUCCAUUUGUUUUGAUGAUGGA | 268 | CAAATGGAG | AAATGGAG | AATGGAG |
| hsa-miR-136* | CAUCAUCGUCUCAAAUGAGUCU | 269 | GACGATGAT | ACGATGAT | CGATGAT |
| hsa-miR-137 | UUAUUGCUUAAGAAUACGCGUAG | 270 | TAAGCAATA | AAGCAATA | AGCAATA |
| hsa-miR-138 | AGCUGGUGUUGUGAAUCAGGCCG | 271 | AACACCAGC | ACACCAGC | CACCAGC |
| hsa-miR-138-1* | GCUACUUCACAACACCAGGGCC | 272 | GTGAAGTAG | TGAAGTAG | GAAGTAG |
| hsa-miR-138-2* | GCUAUUUCACGACACCAGGGUU | 273 | GTGAAATAG | TGAAATAG | GAAATAG |
| hsa-miR-139-3p | GGAGACGCGGCCCUGUUGGAGU | 274 | CCGCGTCTC | CGCGTCTC | GCGTCTC |
| hsa-miR-139-5p | UCUACAGUGCACGUGUCUCCAG | 275 | GCACTGTAG | CACTGTAG | ACTGTAG |
| hsa-miR-140-3p | UACCACAGGGUAGAACCACGG | 276 | CCCTGTGGT | CCTGTGGT | CTGTGGT |
| hsa-miR-140-5p | CAGUGGUUUUACCCUAUGGUAG | 277 | AAAACCACT | AAACCACT | AACCACT |
| hsa-miR-141 | UAACACUGUCUGGUAAAGAUGG | 278 | GACAGTGTT | ACAGTGTT | CAGTGTT |
| hsa-miR-141* | CAUCUUCCAGUACAGUGUUGGA | 279 | CTGGAAGAT | TGGAAGAT | GGAAGAT |
| hsa-miR-142-3p | UGUAGUGUUUCCUACUUUAUGGA | 280 | AAACACTAC | AACACTAC | ACACTAC |
| hsa-miR-142-5p | CAUAAAGUAGAAAGCACUACU | 281 | CTACTTTAT | TACTTTAT | ACTTTAT |
| hsa-miR-143 | UGAGAUGAAGCACUGUAGCUC | 282 | CTTCATCTC | TTCATCTC | TCATCTC |
| hsa-miR-143* | GGUGCAGUGCUGCAUCUCUGGU | 283 | GCACTGCAC | CACTGCAC | ACTGCAC |
| hsa-miR-144 | UACAGUAUAGAUGAUGUACU | 284 | CTATACTGT | TATACTGT | ATACTGT |
| hsa-miR-144* | GGAUAUCAUCAUAUACUGUAAG | 285 | GATGATATC | ATGATATC | TGATATC |
| hsa-miR-145 | GUCCAGUUUUCCCAGGAAUCCCU | 286 | AAAACTGGA | AAACTGGA | AACTGGA |
| hsa-miR-145* | GGAUUCCUGGAAAUACUGUUCU | 287 | CCAGGAATC | CAGGAATC | AGGAATC |
| hsa-miR-1468 | CUCCGUUUGCCUGUUUCGCUG | 288 | GCAAACGGA | CAAACGGA | AAACGGA |

-continued

| microRNA | MicroRNASequence | SEQ ID NO | 9-mer Compound | 8-mer Compound | 7-mer Compound |
|---|---|---|---|---|---|
| hsa-miR-1469 | CUCGGCGCGGGGCGCGGGCUCC | 289 | CCGCGCCGA | CGCGCCGA | GCGCCGA |
| hsa-miR-146a | UGAGAACUGAAUUCCAUGGGUU | 290 | TCAGTTCTC | CAGTTCTC | AGTTCTC |
| hsa-miR-146a* | CCUCUGAAAUUCAGUUCUUCAG | 291 | ATTTCAGAG | TTTCAGAG | TTCAGAG |
| hsa-miR-146b-3p | UGCCCUGUGGACUCAGUUCUGG | 292 | CCACAGGGC | CACAGGGC | ACAGGGC |
| hsa-miR-146b-5p | UGAGAACUGAAUUCCAUAGGCU | 293 | TCAGTTCTC | CAGTTCTC | AGTTCTC |
| hsa-miR-147 | GUGUGUGGAAAUGCUUCUGC | 294 | TTCCACACA | TCCACACA | CCACACA |
| hsa-miR-1470 | GCCCUCCGCCCGUGCACCCCG | 295 | GGCGGAGGG | GCGGAGGG | CGGAGGG |
| hsa-miR-1471 | GCCCGCGUGUGGAGCCAGGUGU | 296 | ACACGCGGG | CACGCGGG | ACGCGGG |
| hsa-miR-147b | GUGUGCGGAAAUGCUUCUGCUA | 297 | TTCCGCACA | TCCGCACA | CCGCACA |
| hsa-miR-148a | UCAGUGCACUACAGAACUUUGU | 298 | AGTGCACTG | GTGCACTG | TGCACTG |
| hsa-miR-148a* | AAAGUUCUGAGACACUCCGACU | 299 | TCAGAACTT | CAGAACTT | AGAACTT |
| hsa-miR-148b | UCAGUGCAUCACAGAACUUUGU | 300 | GATGCACTG | ATGCACTG | TGCACTG |
| hsa-miR-148b* | AAGUUCUGUUAUACACUCAGGC | 301 | AACAGAACT | ACAGAACT | CAGAACT |
| hsa-miR-149 | UCUGGCUCCGUGUCUUCACUCCC | 302 | CGGAGCCAG | GGAGCCAG | GAGCCAG |
| hsa-miR-149* | AGGGAGGGACGGGGCUGUGC | 303 | GTCCCTCCC | TCCCTCCC | CCCTCCC |
| hsa-miR-150 | UCUCCCAACCCUUGUACCAGUG | 304 | GGTTGGGAG | GTTGGGAG | TTGGGAG |
| hsa-miR-150* | CUGGUACAGGCCUGGGGACAG | 305 | CCTGTACCA | CTGTACCA | TGTACCA |
| hsa-miR-151-3p | CUAGACUGAAGCUCCUUGAGG | 306 | TTCAGTCTA | TCAGTCTA | CAGTCTA |
| hsa-miR-151-5p | UCGAGGAGCUCACAGUCUAGU | 307 | AGCTCCTCG | GCTCCTCG | CTCCTCG |
| hsa-miR-152 | UCAGUGCAUGACAGAACUUGG | 308 | CATGCACTG | ATGCACTG | TGCACTG |
| hsa-miR-153 | UUGCAUAGUCACAAAGUGAUC | 309 | GACTATGCA | ACTATGCA | CTATGCA |
| hsa-miR-1537 | AAAACCGUCUAGUUACAGUUGU | 310 | AGACGGTTT | GACGGTTT | ACGGTTT |
| hsa-miR-1538 | CGGCCCGGGCUGCUGCUGUUCCU | 311 | GCCCGGGCC | CCCGGGCC | CCGGGCC |
| hsa-miR-1539 | UCCUGCGCGUCCCAGAUGCCC | 312 | ACGCGCAGG | CGCGCAGG | GCGCAGG |
| hsa-miR-154 | UAGGUUAUCCGUGUUGCCUUCG | 313 | GGATAACCT | GATAACCT | ATAACCT |
| hsa-miR-154* | AAUCAUACACGGUUGACCUAUU | 314 | GTGTATGAT | TGTATGAT | GTATGAT |
| hsa-miR-155 | UUAAUGCUAAUCGUGAUAGGGGU | 315 | TTAGCATTA | TAGCATTA | AGCATTA |
| hsa-miR-155* | CUCCUACAUAUUAGCAUUAACA | 316 | TATGTAGGA | ATGTAGGA | TGTAGGA |
| hsa-miR-15a | UAGCAGCACAUAAUGGUUUGUG | 317 | TGTGCTGCT | GTGCTGCT | TGCTGCT |
| hsa-miR-15a* | CAGGCCAUAUUGUGCUGCCUCA | 318 | ATATGGCCT | TATGGCCT | ATGGCCT |
| hsa-miR-15b | UAGCAGCACAUCAUGGUUUACA | 319 | TGTGCTGCT | GTGCTGCT | TGCTGCT |
| hsa-miR-15b* | CGAAUCAUUAUUUGCUGCUCUA | 320 | TAATGATTC | AATGATTC | ATGATTC |
| hsa-miR-16 | UAGCAGCACGUAAAUAUUGGCG | 321 | CGTGCTGCT | GTGCTGCT | TGCTGCT |
| hsa-miR-16-1* | CCAGUAUUAACUGUGCUGCUGA | 322 | TTAATACTG | TAATACTG | AATACTG |
| hsa-miR-16-2* | CCAAUAUUACUGUGCUGCUUUA | 323 | GTAATATTG | TAATATTG | AATATTG |
| hsa-miR-17 | CAAAGUGCUUACAGUGCAGGUAG | 324 | AAGCACTTT | AGCACTTT | GCACTTT |
| hsa-miR-17* | ACUGCAGUGAAGGCACUUGUAG | 325 | TCACTGCAG | CACTGCAG | ACTGCAG |
| hsa-miR-181a | AACAUUCAACGCUGUCGGUGAGU | 326 | GTTGAATGT | TTGAATGT | TGAATGT |

-continued

| microRNA | MicroRNASequence | SEQ ID NO | 9-mer Compound | 8-mer Compound | 7-mer Compound |
|---|---|---|---|---|---|
| hsa-miR-181a* | ACCAUCGACCGUUGAUUGUACC | 327 | GGTCGATGG | GTCGATGG | TCGATGG |
| hsa-miR-181a-2* | ACCACUGACCGUUGACUGUACC | 328 | GGTCAGTGG | GTCAGTGG | TCAGTGG |
| hsa-miR-181b | AACAUUCAUUGCUGUCGGUGGGU | 329 | AATGAATGT | ATGAATGT | TGAATGT |
| hsa-miR-181c | AACAUUCAACCUGUCGGUGAGU | 330 | GTTGAATGT | TTGAATGT | TGAATGT |
| hsa-miR-181c* | AACCAUCGACCGUUGAGUGGAC | 331 | GTCGATGGT | TCGATGGT | CGATGGT |
| hsa-miR-181d | AACAUUCAUUGUUGUCGGUGGGU | 332 | AATGAATGT | ATGAATGT | TGAATGT |
| hsa-miR-182 | UUUGGCAAUGGUAGAACUCACACU | 333 | CATTGCCAA | ATTGCCAA | TTGCCAA |
| hsa-miR-182* | UGGUUCUAGACUUGCCAACUA | 334 | TCTAGAACC | CTAGAACC | TAGAACC |
| hsa-miR-1825 | UCCAGUGCCCUCCUCUCC | 335 | GGGCACTGG | GGCACTGG | GCACTGG |
| hsa-miR-1826 | AUUGAUCAUCGACACUUCGAACGCAAU | 336 | GATGATCAA | ATGATCAA | TGATCAA |
| hsa-miR-1827 | UGAGGCAGUAGAUUGAAU | 337 | TACTGCCTC | ACTGCCTC | CTGCCTC |
| hsa-miR-183 | UAUGGCACUGGUAGAAUUCACU | 338 | CAGTGCCAT | AGTGCCAT | GTGCCAT |
| hsa-miR-183* | GUGAAUUACCGAAGGGCCAUAA | 339 | GGTAATTCA | GTAATTCA | TAATTCA |
| hsa-miR-184 | UGGACGGAGAACUGAUAAGGGU | 340 | TCTCCGTCC | CTCCGTCC | TCCGTCC |
| hsa-miR-185 | UGGAGAGAAAGGCAGUUCCUGA | 341 | TTTCTCTCC | TTCTCTCC | TCTCTCC |
| hsa-miR-185* | AGGGGCUGGCUUUCCUCUGGUC | 342 | GCCAGCCCC | CCAGCCCC | CAGCCCC |
| hsa-miR-186 | CAAAGAAUUCUCCUUUUGGGCU | 343 | GAATTCTTT | AATTCTTT | ATTCTTT |
| hsa-miR-186* | GCCCAAAGGUGAAUUUUUUGGG | 344 | ACCTTTGGG | CCTTTGGG | CTTTGGG |
| hsa-miR-187 | UCGUGUCUUGUGUUGCAGCCGG | 345 | CAAGACACG | AAGACACG | AGACACG |
| hsa-miR-187* | GGCUACAACACAGGACCCGGGC | 346 | TGTTGTAGC | GTTGTAGC | TTGTAGC |
| hsa-miR-188-3p | CUCCCACAUGCAGGGUUUGCA | 347 | CATGTGGGA | ATGTGGGA | TGTGGGA |
| hsa-miR-188-5p | CAUCCCUUGCAUGGUGGAGGG | 348 | GCAAGGGAT | CAAGGGAT | AAGGGAT |
| hsa-miR-18a | UAAGGUGCAUCUAGUGCAGAUAG | 349 | ATGCACCTT | TGCACCTT | GCACCTT |
| hsa-miR-18a* | ACUGCCCUAAGUGCUCCUUCUGG | 350 | TTAGGGCAG | TAGGGCAG | AGGGCAG |
| hsa-miR-18b | UAAGGUGCAUCUAGUGCAGUUAG | 351 | ATGCACCTT | TGCACCTT | GCACCTT |
| hsa-miR-18b* | UGCCCUAAAUGCCCCUUCUGGC | 352 | ATTTAGGGC | TTTAGGGC | TTAGGGC |
| hsa-miR-190 | UGAUAUGUUUGAUAUAUUAGGU | 353 | AAACATATC | AACATATC | ACATATC |
| hsa-miR-1908 | CGGCGGGGACGGCGAUUGGUC | 354 | GTCCCCGCC | TCCCCGCC | CCCCGCC |
| hsa-miR-1909 | CGCAGGGGCCGGGUGCUCACCG | 355 | GGCCCCTGC | GCCCCTGC | CCCCTGC |
| hsa-miR-1909* | UGAGUGCCGGUGCCUGCCCUG | 356 | CCGGCACTC | CGGCACTC | GGCACTC |
| hsa-miR-190b | UGAUAUGUUUGAUAUUGGGUU | 357 | AAACATATC | AACATATC | ACATATC |
| hsa-miR-191 | CAACGGAAUCCCAAAAGCAGCUG | 358 | GATTCCGTT | ATTCCGTT | TTCCGTT |
| hsa-miR-191* | GCUGCGCUUGGAUUUCGUCCCC | 359 | CAAGCGCAG | AAGCGCAG | AGCGCAG |
| hsa-miR-1910 | CCAGUCCUGUGCCUGCCGCCU | 360 | ACAGGACTG | CAGGACTG | AGGACTG |
| hsa-miR-1911 | UGAGUACCGCCAUGUCUGUUGGG | 361 | GCGGTACTC | CGGTACTC | GGTACTC |
| hsa-miR-1911* | CACCAGGCAUUGUGGUCUCC | 362 | ATGCCTGGT | TGCCTGGT | GCCTGGT |
| hsa-miR-1912 | UACCCAGAGCAUGCAGUGUGAA | 363 | GCTCTGGGT | CTCTGGGT | TCTGGGT |
| hsa-miR-1913 | UCUGCCCCCUCCGCUGCUGCCA | 364 | AGGGGGCAG | GGGGGCAG | GGGGCAG |

-continued

| microRNA | MicroRNASequence | SEQ ID NO | 9-mer Compound | 8-mer Compound | 7-mer Compound |
|---|---|---|---|---|---|
| hsa-miR-1914 | CCCUGUGCCCGGCCCACUUCUG | 365 | GGGCACAGG | GGCACAGG | GCACAGG |
| hsa-miR-1914* | GGAGGGGUCCCGCACUGGGAGG | 366 | GGACCCCTC | GACCCCTC | ACCCCTC |
| hsa-miR-1915 | CCCCAGGGCGACGCGGCGGG | 367 | CGCCCTGGG | GCCCTGGG | CCCTGGG |
| hsa-miR-1915* | ACCUUGCCUUGCUGCCCGGGCC | 368 | AAGGCAAGG | AGGCAAGG | GGCAAGG |
| hsa-miR-192 | CUGACCUAUGAAUUGACAGCC | 369 | CATAGGTCA | ATAGGTCA | TAGGTCA |
| hsa-miR-192* | CUGCCAAUUCCAUAGGUCACAG | 370 | GAATTGGCA | AATTGGCA | ATTGGCA |
| hsa-miR-193a-3p | AACUGGCCUACAAAGUCCCAGU | 371 | TAGGCCAGT | AGGCCAGT | GGCCAGT |
| hsa-miR-193a-5p | UGGGUCUUUGCGGGCGAGAUGA | 372 | CAAAGACCC | AAAGACCC | AAGACCC |
| hsa-miR-193b | AACUGGCCCUCAAAGUCCCGCU | 373 | AGGGCCAGT | GGGCCAGT | GGCCAGT |
| hsa-miR-193b* | CGGGGUUUUGAGGGCGAGAUGA | 374 | CAAAACCCC | AAAACCCC | AAACCCC |
| hsa-miR-194 | UGUAACAGCAACUCCAUGUGGA | 375 | TGCTGTTAC | GCTGTTAC | CTGTTAC |
| hsa-miR-194* | CCAGUGGGGCUGCUGUUAUCUG | 376 | GCCCCACTG | CCCCACTG | CCCACTG |
| hsa-miR-195 | UAGCAGCACAGAAAUAUUGGC | 377 | TGTGCTGCT | GTGCTGCT | TGCTGCT |
| hsa-miR-195* | CCAAUAUUGGCUGUGCUGCUCC | 378 | CCAATATTG | CAATATTG | AATATTG |
| hsa-miR-196a | UAGGUAGUUUCAUGUUGUUGGG | 379 | AAACTACCT | AACTACCT | ACTACCT |
| hsa-miR-196a* | CGGCAACAAGAAACUGCCUGAG | 380 | CTTGTTGCC | TTGTTGCC | TGTTGCC |
| hsa-miR-196b | UAGGUAGUUUCCUGUUGUUGGG | 381 | AAACTACCT | AACTACCT | ACTACCT |
| hsa-miR-197 | UUCACCACCUUCUCCACCCAGC | 382 | AGGTGGTGA | GGTGGTGA | GTGGTGA |
| hsa-miR-198 | GGUCCAGAGGGGAGAUAGGUUC | 383 | CCTCTGGAC | CTCTGGAC | TCTGGAC |
| hsa-miR-199a-5p | CCCAGUGUUCAGACUACCUGUUC | 384 | GAACACTGG | AACACTGG | ACACTGG |
| hsa-miR-199b-3p | ACAGUAGUCUGCACAUUGGUUA | 385 | AGACTACTG | GACTACTG | ACTACTG |
| hsa-miR-199b-5p | CCCAGUGUUUAGACUAUCUGUUC | 386 | AAACACTGG | AACACTGG | ACACTGG |
| hsa-miR-19a | UGUGCAAAUCUAUGCAAAACUGA | 387 | GATTTGCAC | ATTTGCAC | TTTGCAC |
| hsa-miR-19a* | AGUUUUGCAUAGUUGCACUACA | 388 | ATGCAAAAC | TGCAAAAC | GCAAAAC |
| hsa-miR-19b | UGUGCAAAUCCAUGCAAAACUGA | 389 | GATTTGCAC | ATTTGCAC | TTTGCAC |
| hsa-miR-19b-1* | AGUUUUGCAGGUUUGCAUCCAGC | 390 | CTGCAAAAC | TGCAAAAC | GCAAAAC |
| hsa-miR-19b-2* | AGUUUUGCAGGUUUGCAUUUCA | 391 | CTGCAAAAC | TGCAAAAC | GCAAAAC |
| hsa-miR-200a | UAACACUGUCUGGUAACGAUGU | 392 | GACAGTGTT | ACAGTGTT | CAGTGTT |
| hsa-miR-200a* | CAUCUUACCGGACAGUGCUGGA | 393 | CGGTAAGAT | GGTAAGAT | GTAAGAT |
| hsa-miR-200b | UAAUACUGCCUGGUAAUGAUGA | 394 | GGCAGTATT | GCAGTATT | CAGTATT |
| hsa-miR-200b* | CAUCUUACUGGGCAGCAUUGGA | 395 | CAGTAAGAT | AGTAAGAT | GTAAGAT |
| hsa-miR-200c | UAAUACUGCCGGGUAAUGAUGGA | 396 | GGCAGTATT | GCAGTATT | CAGTATT |
| hsa-miR-200c* | CGUCUUACCCAGCAGUGUUUGG | 397 | GGGTAAGAC | GGTAAGAC | GTAAGAC |
| hsa-miR-202 | AGAGGUAUAGGGCAUGGGAA | 398 | CTATACCTC | TATACCTC | ATACCTC |
| hsa-miR-202* | UUCCUAUGCAUAUACUUCUUUG | 399 | TGCATAGGA | GCATAGGA | CATAGGA |
| hsa-miR-203 | GUGAAAUGUUUAGGACCACUAG | 400 | AACATTTCA | ACATTTCA | CATTTCA |
| hsa-miR-204 | UUCCCUUUGUCAUCCUAUGCCU | 401 | ACAAAGGGA | CAAAGGGA | AAAGGGA |
| hsa-miR-205 | UCCUUCAUUCCACCGGAGUCUG | 402 | GAATGAAGG | AATGAAGG | ATGAAGG |

-continued

| microRNA | MicroRNASequence | SEQ ID NO | 9-mer Compound | 8-mer Compound | 7-mer Compound |
|---|---|---|---|---|---|
| hsa-miR-206 | UGGAAUGUAAGGAAGUGUGUGG | 403 | TTACATTCC | TACATTCC | ACATTCC |
| hsa-miR-208a | AUAAGACGAGCAAAAAGCUUGU | 404 | CTCGTCTTA | TCGTCTTA | CGTCTTA |
| hsa-miR-208b | AUAAGACGAACAAAAGGUUUGU | 405 | TTCGTCTTA | TCGTCTTA | CGTCTTA |
| hsa-miR-20a | UAAAGUGCUUAUAGUGCAGGUAG | 406 | AAGCACTTT | AGCACTTT | GCACTTT |
| hsa-miR-20a* | ACUGCAUUAUGAGCACUUAAAG | 407 | ATAATGCAG | TAATGCAG | AATGCAG |
| hsa-miR-20b | CAAAGUGCUCAUAGUGCAGGUAG | 408 | GAGCACTTT | AGCACTTT | GCACTTT |
| hsa-miR-20b* | ACUGUAGUAUGGGCACUUCCAG | 409 | ATACTACAG | TACTACAG | ACTACAG |
| hsa-miR-21 | UAGCUUAUCAGACUGAUGUUGA | 410 | TGATAAGCT | GATAAGCT | ATAAGCT |
| hsa-miR-21* | CAACACCAGUCGAUGGGCUGU | 411 | ACTGGTGTT | CTGGTGTT | TGGTGTT |
| hsa-miR-210 | CUGUGCGUGUGACAGCGGCUGA | 412 | ACACGCACA | CACGCACA | ACGCACA |
| hsa-miR-211 | UUCCCUUUGUCAUCCUUCGCCU | 413 | ACAAAGGGA | CAAAGGGA | AAAGGGA |
| hsa-miR-212 | UAACAGUCUCCAGUCACGGCC | 414 | GAGACTGTT | AGACTGTT | GACTGTT |
| hsa-miR-214 | ACAGCAGGCACAGACAGGCAGU | 415 | TGCCTGCTG | GCCTGCTG | CCTGCTG |
| hsa-miR-214* | UGCCUGUCUACACUUGCUGUGC | 416 | TAGACAGGC | AGACAGGC | GACAGGC |
| hsa-miR-215 | AUGACCUAUGAAUUGACAGAC | 417 | CATAGGTCA | ATAGGTCA | TAGGTCA |
| hsa-miR-216a | UAAUCUCAGCUGGCAACUGUGA | 418 | GCTGAGATT | CTGAGATT | TGAGATT |
| hsa-miR-216b | AAAUCUCUGCAGGCAAAUGUGA | 419 | GCAGAGATT | CAGAGATT | AGAGATT |
| hsa-miR-217 | UACUGCAUCAGGAACUGAUUGGA | 420 | TGATGCAGT | GATGCAGT | ATGCAGT |
| hsa-miR-218 | UUGUGCUUGAUCUAACCAUGU | 421 | TCAAGCACA | CAAGCACA | AAGCACA |
| hsa-miR-218-1* | AUGGUUCCGUCAAGCACCAUGG | 422 | ACGGAACCA | CGGAACCA | GGAACCA |
| hsa-miR-218-2* | CAUGGUUCUGUCAAGCACCGCG | 423 | CAGAACCAT | AGAACCAT | GAACCAT |
| hsa-miR-219-1-3p | AGAGUUGAGUCUGGACGUCCCG | 424 | ACTCAACTC | CTCAACTC | TCAACTC |
| hsa-miR-219-2-3p | AGAAUUGUGGCUGGACAUCUGU | 425 | CCACAATTC | CACAATTC | ACAATTC |
| hsa-miR-219-5p | UGAUUGUCCAAACGCAAUUCU | 426 | TGGACAATC | GGACAATC | GACAATC |
| hsa-miR-22 | AAGCUGCCAGUUGAAGAACUGU | 427 | CTGGCAGCT | TGGCAGCT | GGCAGCT |
| hsa-miR-22* | AGUUCUUCAGUGGCAAGCUUUA | 428 | CTGAAGAAC | TGAAGAAC | GAAGAAC |
| hsa-miR-220a | CCACACCGUAUCUGACACUUU | 429 | TACGGTGTG | ACGGTGTG | CGGTGTG |
| hsa-miR-220b | CCACCACCGUGUCUGACACUU | 430 | ACGGTGGTG | CGGTGGTG | GGTGGTG |
| hsa-miR-220c | ACACAGGGCUGUUGUGAAGACU | 431 | AGCCCTGTG | GCCCTGTG | CCCTGTG |
| hsa-miR-221 | AGCUACAUUGUCUGCUGGGUUUC | 432 | CAATGTAGC | AATGTAGC | ATGTAGC |
| hsa-miR-221* | ACCUGGCAUACAAUGUAGAUUU | 433 | TATGCCAGG | ATGCCAGG | TGCCAGG |
| hsa-miR-222 | AGCUACAUCUGGCUACUGGGU | 434 | AGATGTAGC | GATGTAGC | ATGTAGC |
| hsa-miR-222* | CUCAGUAGCCAGUGUAGAUCCU | 435 | GGCTACTGA | GCTACTGA | CTACTGA |
| hsa-miR-223 | UGUCAGUUUGUCAAAUACCCCA | 436 | CAAACTGAC | AAACTGAC | AACTGAC |
| hsa-miR-223* | CGUGUAUUUGACAAGCUGAGUU | 437 | CAAATACAC | AAATACAC | AATACAC |
| hsa-miR-224 | CAAGUCACUAGUGGUUCCGUU | 438 | TAGTGACTT | AGTGACTT | GTGACTT |
| hsa-miR-23a | AUCACAUUGCCAGGGAUUUCC | 439 | GCAATGTGA | CAATGTGA | AATGTGA |
| hsa-miR-23a* | GGGGUUCCUGGGGAUGGGAUUU | 440 | CAGGAACCC | AGGAACCC | GGAACCC |

-continued

| microRNA | MicroRNASequence | SEQ ID NO | 9-mer Compound | 8-mer Compound | 7-mer Compound |
|---|---|---|---|---|---|
| hsa-miR-23b | AUCACAUUGCCAGGGAUUACC | 441 | GCAATGTGA | CAATGTGA | AATGTGA |
| hsa-miR-23b* | UGGGUUCCUGGCAUGCUGAUUU | 442 | CAGGAACCC | AGGAACCC | GGAACCC |
| hsa-miR-24 | UGGCUCAGUUCAGCAGGAACAG | 443 | AACTGAGCC | ACTGAGCC | CTGAGCC |
| hsa-miR-24-1* | UGCCUACUGAGCUGAUAUCAGU | 444 | TCAGTAGGC | CAGTAGGC | AGTAGGC |
| hsa-miR-24-2* | UGCCUACUGAGCUGAAACACAG | 445 | TCAGTAGGC | CAGTAGGC | AGTAGGC |
| hsa-miR-25 | CAUUGCACUUGUCUCGGUCUGA | 446 | AAGTGCAAT | AGTGCAAT | GTGCAAT |
| hsa-miR-25* | AGGCGGAGACUUGGGCAAUUG | 447 | GTCTCCGCC | TCTCCGCC | CTCCGCC |
| hsa-miR-26a | UUCAAGUAAUCCAGGAUAGGCU | 448 | ATTACTTGA | TTACTTGA | TACTTGA |
| hsa-miR-26a-1* | CCUAUUCUUGGUUACUUGCACG | 449 | CAAGAATAG | AAGAATAG | AGAATAG |
| hsa-miR-26a-2* | CCUAUUCUUGAUUACUUGUUUC | 450 | CAAGAATAG | AAGAATAG | AGAATAG |
| hsa-miR-26b | UUCAAGUAAUUCAGGAUAGGU | 451 | ATTACTTGA | TTACTTGA | TACTTGA |
| hsa-miR-26b* | CCUGUUCUCCAUUACUUGGCUC | 452 | GGAGAACAG | GAGAACAG | AGAACAG |
| hsa-miR-27a | UUCACAGUGGCUAAGUUCCGC | 453 | CCACTGTGA | CACTGTGA | ACTGTGA |
| hsa-miR-27a* | AGGGCUUAGCUGCUUGUGAGCA | 454 | GCTAAGCCC | CTAAGCCC | TAAGCCC |
| hsa-miR-27b | UUCACAGUGGCUAAGUUCUGC | 455 | CCACTGTGA | CACTGTGA | ACTGTGA |
| hsa-miR-27b* | AGAGCUUAGCUGAUUGGUGAAC | 456 | GCTAAGCTC | CTAAGCTC | TAAGCTC |
| hsa-miR-28-3p | CACUAGAUUGUGAGCUCCUGGA | 457 | CAATCTAGT | AATCTAGT | ATCTAGT |
| hsa-miR-28-5p | AAGGAGCUCACAGUCUAUUGAG | 458 | TGAGCTCCT | GAGCTCCT | AGCTCCT |
| hsa-miR-296-3p | GAGGGUUGGGUGGAGGCUCUCC | 459 | CCCAACCCT | CCAACCCT | CAACCCT |
| hsa-miR-296-5p | AGGGCCCCCCUCAAUCCUGU | 460 | GGGGGGCCC | GGGGGCCC | GGGGCCC |
| hsa-miR-297 | AUGUAUGUGUGCAUGUGCAUG | 461 | ACACATACA | CACATACA | ACATACA |
| hsa-miR-298 | AGCAGAAGCAGGGAGGUUCUCCCA | 462 | TGCTTCTGC | GCTTCTGC | CTTCTGC |
| hsa-miR-299-3p | UAUGUGGGAUGGUAAACCGCUU | 463 | ATCCCACAT | TCCCACAT | CCCACAT |
| hsa-miR-299-5p | UGGUUUACCGUCCCACAUACAU | 464 | CGGTAAACC | GGTAAACC | GTAAACC |
| hsa-miR-29a | UAGCACCAUCUGAAAUCGGUUA | 465 | GATGGTGCT | ATGGTGCT | TGGTGCT |
| hsa-miR-29a* | ACUGAUUUCUUUUGGUGUUCAG | 466 | AGAAATCAG | GAAATCAG | AAATCAG |
| hsa-miR-29b | UAGCACCAUUUGAAAUCAGUGUU | 467 | AATGGTGCT | ATGGTGCT | TGGTGCT |
| hsa-miR-29b-1* | GCUGGUUUCAUAUGGUGGUUUAGA | 468 | TGAAACCAG | GAAACCAG | AAACCAG |
| hsa-miR-29b-2* | CUGGUUUCACAUGGUGGCUUAG | 469 | GTGAAACCA | TGAAACCA | GAAACCA |
| hsa-miR-29c | UAGCACCAUUUGAAAUCGGUUA | 470 | AATGGTGCT | ATGGTGCT | TGGTGCT |
| hsa-miR-29c* | UGACCGAUUUCUCCUGGUGUUC | 471 | AAATCGGTC | AATCGGTC | ATCGGTC |
| hsa-miR-300 | UAUACAAGGGCAGACUCUCUCU | 472 | CCCTTGTAT | CCTTGTAT | CTTGTAT |
| hsa-miR-301a | CAGUGCAAUAGUAUUGUCAAAGC | 473 | TATTGCACT | ATTGCACT | TTGCACT |
| hsa-miR-301b | CAGUGCAAUGAUAUUGUCAAAGC | 474 | CATTGCACT | ATTGCACT | TTGCACT |
| hsa-miR-302a | UAAGUGCUUCCAUGUUUUGGUGA | 475 | GAAGCACTT | AAGCACTT | AGCACTT |
| hsa-miR-302a* | ACUUAAACGUGGAUGUACUUGCU | 476 | ACGTTTAAG | CGTTTAAG | GTTTAAG |
| hsa-miR-302b | UAAGUGCUUCCAUGUUUUAGUAG | 477 | GAAGCACTT | AAGCACTT | AGCACTT |
| hsa-miR-302b* | ACUUAAACAUGGAAGUGCUUUC | 478 | ATGTTAAAG | TGTTAAAG | GTTAAAG |

-continued

| microRNA | MicroRNASequence | SEQ ID NO | 9-mer Compound | 8-mer Compound | 7-mer Compound |
|---|---|---|---|---|---|
| hsa-miR-302c | UAAGUGCUUCCAUGUUUCAGUGG | 479 | GAAGCACTT | AAGCACTT | AGCACTT |
| hsa-miR-302c* | UUUAACAUGGGGGUACCUGCUG | 480 | CCATGTTAA | CATGTTAA | ATGTTAA |
| hsa-miR-302d | UAAGUGCUUCCAUGUUUGAGUGU | 481 | GAAGCACTT | AAGCACTT | AGCACTT |
| hsa-miR-302d* | ACUUUAACAUGGAGGCACUUGC | 482 | ATGTTAAAG | TGTTAAAG | GTTAAAG |
| hsa-miR-302e | UAAGUGCUUCCAUGCUU | 483 | GAAGCACTT | AAGCACTT | AGCACTT |
| hsa-miR-302f | UAAUUGCUUCCAUGUUU | 484 | GAAGCAATT | AAGCAATT | AGCAATT |
| hsa-miR-30a | UGUAAACAUCCUCGACUGGAAG | 485 | GATGTTTAC | ATGTTTAC | TGTTTAC |
| hsa-miR-30a* | CUUUCAGUCGGAUGUUUGCAGC | 486 | CGACTGAAA | GACTGAAA | ACTGAAA |
| hsa-miR-30b | UGUAAACAUCCUACACUCAGCU | 487 | GATGTTTAC | ATGTTTAC | TGTTTAC |
| hsa-miR-30b* | CUGGGAGGUGGAUGUUUACUUC | 488 | CACCTCCCA | ACCTCCCA | CCTCCCA |
| hsa-miR-30c | UGUAAACAUCCUACACUCUCAGC | 489 | GATGTTTAC | ATGTTTAC | TGTTTAC |
| hsa-miR-30c-1* | CUGGGAGAGGGUUGUUUACUCC | 490 | CCTCTCCCA | CTCTCCCA | TCTCCCA |
| hsa-miR-30c-2* | CUGGGAGAAGGCUGUUUACUCU | 491 | CTTCTCCCA | TTCTCCCA | TCTCCCA |
| hsa-miR-30d | UGUAAACAUCCCCGACUGGAAG | 492 | GATGTTTAC | ATGTTTAC | TGTTTAC |
| hsa-miR-30d* | CUUUCAGUCAGAUGUUUGCUGC | 493 | TGACTGAAA | GACTGAAA | ACTGAAA |
| hsa-miR-30e | UGUAAACAUCCUUGACUGGAAG | 494 | GATGTTTAC | ATGTTTAC | TGTTTAC |
| hsa-miR-30e* | CUUUCAGUCGGAUGUUUACAGC | 495 | CGACTGAAA | GACTGAAA | ACTGAAA |
| hsa-miR-31 | AGGCAAGAUGCUGGCAUAGCU | 496 | CATCTTGCC | ATCTTGCC | TCTTGCC |
| hsa-miR-31* | UGCUAUGCCAACAUAUUGCCAU | 497 | TGGCATAGC | GGCATAGC | GCATAGC |
| hsa-miR-32 | UAUUGCACAUUACUAAGUUGCA | 498 | ATGTGCAAT | TGTGCAAT | GTGCAAT |
| hsa-miR-32* | CAAUUUAGUGUGUGUGAUAUUU | 499 | CACTAAATT | ACTAAATT | CTAAATT |
| hsa-miR-320a | AAAAGCUGGGUUGAGAGGGCGA | 500 | CCCAGCTTT | CCAGCTTT | CAGCTTT |
| hsa-miR-320b | AAAAGCUGGGUUGAGAGGGCAA | 501 | CCCAGCTTT | CCAGCTTT | CAGCTTT |
| hsa-miR-320c | AAAAGCUGGGUUGAGAGGGU | 502 | CCCAGCTTT | CCAGCTTT | CAGCTTT |
| hsa-miR-320d | AAAAGCUGGGUUGAGAGGA | 503 | CCCAGCTTT | CCAGCTTT | CAGCTTT |
| hsa-miR-323-3p | CACAUUACACGGUCGACCUCU | 504 | GTGTAATGT | TGTAATGT | GTAATGT |
| hsa-miR-323-5p | AGGUGGUCCGUGGCGCGUUCGC | 505 | CGGACCACC | GGACCACC | GACCACC |
| hsa-miR-324-3p | ACUGCCCCAGGUGCUGCUGG | 506 | CTGGGGCAG | TGGGGCAG | GGGGCAG |
| hsa-miR-324-5p | CGCAUCCCCUAGGGCAUUGGUGU | 507 | AGGGGATGC | GGGGATGC | GGGATGC |
| hsa-miR-325 | CCUAGUAGGUGUCCAGUAAGUGU | 508 | ACCTACTAG | CCTACTAG | CTACTAG |
| hsa-miR-326 | CCUCUGGGCCCUUCCUCCAG | 509 | GGCCCAGAG | GCCCAGAG | CCCAGAG |
| hsa-miR-328 | CUGGCCCUCUCUGCCCUUCCGU | 510 | AGAGGGCCA | GAGGGCCA | AGGGCCA |
| hsa-miR-329 | AACACACCUGGUUAACCUCUUU | 511 | CAGGTGTGT | AGGTGTGT | GGTGTGT |
| hsa-miR-330-3p | GCAAAGCACACGGCCUGCAGAGA | 512 | TGTGCTTTG | GTGCTTTG | TGCTTTG |
| hsa-miR-330-5p | UCUCUGGGCCUGUGUCUUAGGC | 513 | GGCCCAGAG | GCCCAGAG | CCCAGAG |
| hsa-miR-331-3p | GCCCCUGGGCCUAUCCUAGAA | 514 | GCCCAGGGG | CCCAGGGG | CCAGGGG |
| hsa-miR-331-5p | CUAGGUAUGGUCCCAGGGAUCC | 515 | CCATACCTA | CATACCTA | ATACCTA |
| hsa-miR-335 | UCAAGAGCAAUAACGAAAAAUGU | 516 | TTGCTCTTG | TGCTCTTG | GCTCTTG |

-continued

| microRNA | MicroRNASequence | SEQ ID NO | 9-mer Compound | 8-mer Compound | 7-mer Compound |
| --- | --- | --- | --- | --- | --- |
| hsa-miR-335* | UUUUUCAUUAUUGCUCCUGACC | 517 | TAATGAAAA | AATGAAAA | ATGAAAA |
| hsa-miR-337-3p | CUCCUAUAUGAUGCCUUUCUUC | 518 | CATATAGGA | ATATAGGA | TATAGGA |
| hsa-miR-337-5p | GAACGGCUUCAUACAGGAGUU | 519 | GAAGCCGTT | AAGCCGTT | AGCCGTT |
| hsa-miR-338-3p | UCCAGCAUCAGUGAUUUUGUUG | 520 | TGATGCTGG | GATGCTGG | ATGCTGG |
| hsa-miR-338-5p | AACAAUAUCCUGGUGCUGAGUG | 521 | GGATATTGT | GATATTGT | ATATTGT |
| hsa-miR-339-3p | UGAGCGCCUCGACGACAGAGCCG | 522 | GAGGCGCTC | AGGCGCTC | GGCGCTC |
| hsa-miR-339-5p | UCCCUGUCCUCCAGGAGCUCACG | 523 | AGGACAGGG | GGACAGGG | GACAGGG |
| hsa-miR-33a | GUGCAUUGUAGUUGCAUUGCA | 524 | TACAATGCA | ACAATGCA | CAATGCA |
| hsa-miR-33a* | CAAUGUUUCCACAGUGCAUCAC | 525 | GGAAACATT | GAAACATT | AAACATT |
| hsa-miR-33b | GUGCAUUGCUGUUGCAUUGC | 526 | AGCAATGCA | GCAATGCA | CAATGCA |
| hsa-miR-33b* | CAGUGCCUCGGCAGUGCAGCCC | 527 | CGAGGCACT | GAGGCACT | AGGCACT |
| hsa-miR-340 | UUAUAAAGCAAUGAGACUGAUU | 528 | TGCTTTATA | GCTTTATA | CTTTATA |
| hsa-miR-340* | UCCGUCUCAGUUACUUUAUAGC | 529 | CTGAGACGG | TGAGACGG | GAGACGG |
| hsa-miR-342-3p | UCUCACACAGAAAUCGCACCCGU | 530 | CTGTGTGAG | TGTGTGAG | GTGTGAG |
| hsa-miR-342-5p | AGGGGUGCUAUCUGUGAUUGA | 531 | TAGCACCCC | AGCACCCC | GCACCCC |
| hsa-miR-345 | GCUGACUCCUAGUCCAGGGCUC | 532 | AGGAGTCAG | GGAGTCAG | GAGTCAG |
| hsa-miR-346 | UGUCUGCCCGCAUGCCUGCCUCU | 533 | CGGGCAGAC | GGGCAGAC | GGCAGAC |
| hsa-miR-34a | UGGCAGUGUCUUAGCUGGUUGU | 534 | GACACTGCC | ACACTGCC | CACTGCC |
| hsa-miR-34a* | CAAUCAGCAAGUAUACUGCCCU | 535 | TTGCTGATT | TGCTGATT | GCTGATT |
| hsa-miR-34b | CAAUCACUAACUCCACUGCCAU | 536 | TTAGTGATT | TAGTGATT | AGTGATT |
| hsa-miR-34b* | UAGGCAGUGUCAUUAGCUGAUUG | 537 | ACACTGCCT | CACTGCCT | ACTGCCT |
| hsa-miR-34c-3p | AAUCACUAACCACACGGCCAGG | 538 | GTTAGTGAT | TTAGTGAT | TAGTGAT |
| hsa-miR-34c-5p | AGGCAGUGUAGUUAGCUGAUUGC | 539 | TACACTGCC | ACACTGCC | CACTGCC |
| hsa-miR-361-3p | UCCCCCAGGUGUGAUUCUGAUUU | 540 | ACCTGGGGG | CCTGGGGG | CTGGGGG |
| hsa-miR-361-5p | UUAUCAGAAUCUCCAGGGGUAC | 541 | ATTCTGATA | TTCTGATA | TCTGATA |
| hsa-miR-362-3p | AACACACCUAUUCAAGGAUUCA | 542 | TAGGTGTGT | AGGTGTGT | GGTGTGT |
| hsa-miR-362-5p | AAUCCUUGGAACCUAGGUGUGAGU | 543 | TCCAAGGAT | CCAAGGAT | CAAGGAT |
| hsa-miR-363 | AAUUGCACGGUAUCCAUCUGUA | 544 | CCGTGCAAT | CGTGCAAT | GTGCAAT |
| hsa-miR-363* | CGGGUGGAUCACGAUGCAAUUU | 545 | GATCCACCC | ATCCACCC | TCCACCC |
| hsa-miR-365 | UAAUGCCCCUAAAAAUCCUUAU | 546 | AGGGGCATT | GGGGCATT | GGGCATT |
| hsa-miR-367 | AAUUGCACUUUAGCAAUGGUGA | 547 | AAGTGCAAT | AGTGCAAT | GTGCAAT |
| hsa-miR-367* | ACUGUUGCUAAUAUGCAACUCU | 548 | TAGCAACAG | AGCAACAG | GCAACAG |
| hsa-miR-369-3p | AAUAAUACAUGGUUGAUCUUU | 549 | ATGTATTAT | TGTATTAT | GTATTAT |
| hsa-miR-369-5p | AGAUCGACCGUGUUAUAUUCGC | 550 | CGGTCGATC | GGTCGATC | GTCGATC |
| hsa-miR-370 | GCCUGCUGGGGUGGAACCUGGU | 551 | CCCAGCAGG | CCAGCAGG | CAGCAGG |
| hsa-miR-371-3p | AAGUGCCGCCAUCUUUUGAGUGU | 552 | GGCGGCACT | GCGGCACT | CGGCACT |
| hsa-miR-371-5p | ACUCAAACUGUGGGGGCACU | 553 | CAGTTTGAG | AGTTTGAG | GTTTGAG |
| hsa-miR-372 | AAAGUGCUGCGACAUUUGAGCGU | 554 | GCAGCACTT | CAGCACTT | AGCACTT |

-continued

| microRNA | MicroRNASequence | SEQ ID NO | 9-mer Compound | 8-mer Compound | 7-mer Compound |
|---|---|---|---|---|---|
| hsa-miR-373 | GAAGUGCUUCGAUUUUGGGGUGU | 555 | GAAGCACTT | AAGCACTT | AGCACTT |
| hsa-miR-373* | ACUCAAAAUGGGGCGCUUUCC | 556 | CATTTTGAG | ATTTTGAG | TTTTGAG |
| hsa-miR-374a | UUAUAAUACAACCUGAUAAGUG | 557 | TGTATTATA | GTATTATA | TATTATA |
| hsa-miR-374a* | CUUAUCAGAUUGUAUUGUAAUU | 558 | ATCTGATAA | TCTGATAA | CTGATAA |
| hsa-miR-374b | AUAUAAUACAACCUGCUAAGUG | 559 | TGTATTATA | GTATTATA | TATTATA |
| hsa-miR-374b* | CUUAGCAGGUUGUAUUAUCAUU | 560 | ACCTGCTAA | CCTGCTAA | CTGCTAA |
| hsa-miR-375 | UUUGUUCGUUCGGCUCGCGUGA | 561 | AACGAACAA | ACGAACAA | CGAACAA |
| hsa-miR-376a | AUCAUAGAGGAAAAUCCACGU | 562 | CCTCTATGA | CTCTATGA | TCTATGA |
| hsa-miR-376a* | GUAGAUUCUCCUUCUAUGAGUA | 563 | GAGAATCTA | AGAATCTA | GAATCTA |
| hsa-miR-376b | AUCAUAGAGGAAAAUCCAUGUU | 564 | CCTCTATGA | CTCTATGA | TCTATGA |
| hsa-miR-376c | AACAUAGAGGAAAUUCCACGU | 565 | CCTCTATGT | CTCTATGT | TCTATGT |
| hsa-miR-377 | AUCACACAAAGGCAACUUUUGU | 566 | TTTGTGTGA | TTGTGTGA | TGTGTGA |
| hsa-miR-377* | AGAGGUUGCCCUUGGUGAAUUC | 567 | GGCAACCTC | GCAACCTC | CAACCTC |
| hsa-miR-378 | ACUGGACUUGGAGUCAGAAGG | 568 | CAAGTCCAG | AAGTCCAG | AGTCCAG |
| hsa-miR-378* | CUCCUGACUCCAGGUCCUGUGU | 569 | GAGTCAGGA | AGTCAGGA | GTCAGGA |
| hsa-miR-379 | UGGUAGACUAUGGAACGUAGG | 570 | TAGTCTACC | AGTCTACC | GTCTACC |
| hsa-miR-379* | UAUGUAACAUGGUCCACUAACU | 571 | ATGTTACAT | TGTTACAT | GTTACAT |
| hsa-miR-380 | UAUGUAAUAUGGUCCACAUCUU | 572 | ATATTACAT | TATTACAT | ATTACAT |
| hsa-miR-380* | UGGUUGACCAUAGAACAUGCGC | 573 | TGGTCAACC | GGTCAACC | GTCAACC |
| hsa-miR-381 | UAUACAAGGGCAAGCUCUCUGU | 574 | CCCTTGTAT | CCTTGTAT | CTTGTAT |
| hsa-miR-382 | GAAGUUGUUCGUGGUGGAUUCG | 575 | GAACAACTT | AACAACTT | ACAACTT |
| hsa-miR-383 | AGAUCAGAAGGUGAUUGUGGCU | 576 | CTTCTGATC | TTCTGATC | TCTGATC |
| hsa-miR-384 | AUUCCUAGAAAUUGUUCAUA | 577 | TTCTAGGAA | TCTAGGAA | CTAGGAA |
| hsa-miR-409-3p | GAAUGUUGCUCGGUGAACCCCU | 578 | AGCAACATT | GCAACATT | CAACATT |
| hsa-miR-409-5p | AGGUUACCCGAGCAACUUUGCAU | 579 | CGGGTAACC | GGGTAACC | GGTAACC |
| hsa-miR-410 | AAUAUAACACAGAUGGCCUGU | 580 | GTGTTATAT | TGTTATAT | GTTATAT |
| hsa-miR-411 | UAGUAGACCGUAUAGCGUACG | 581 | CGGTCTACT | GGTCTACT | GTCTACT |
| hsa-miR-411* | UAUGUAACACGGUCCACUAACC | 582 | GTGTTACAT | TGTTACAT | GTTACAT |
| hsa-miR-412 | ACUUCACCUGGUCCACUAGCCGU | 583 | CAGGTGAAG | AGGTGAAG | GGTGAAG |
| hsa-miR-421 | AUCAACAGACAUUAAUUGGGCGC | 584 | GTCTGTTGA | TCTGTTGA | CTGTTGA |
| hsa-miR-422a | ACUGGACUUAGGGUCAGAAGGC | 585 | TAAGTCCAG | AAGTCCAG | AGTCCAG |
| hsa-miR-423-3p | AGCUCGGUCUGAGGCCCCUCAGU | 586 | AGACCGAGC | GACCGAGC | ACCGAGC |
| hsa-miR-423-5p | UGAGGGGCAGAGAGCGAGACUUU | 587 | CTGCCCCTC | TGCCCCTC | GCCCCTC |
| hsa-miR-424 | CAGCAGCAAUUCAUGUUUUGAA | 588 | ATTGCTGCT | TTGCTGCT | TGCTGCT |
| hsa-miR-424* | CAAAACGUGAGGCGCUGCUAU | 589 | TCACGTTTT | CACGTTTT | ACGTTTT |
| hsa-miR-425 | AAUGACACGAUCACUCCCGUUGA | 590 | TCGTGTCAT | CGTGTCAT | GTGTCAT |
| hsa-miR-425* | AUCGGGAAUGUCGUGUCCGCCC | 591 | CATTCCCGA | ATTCCCGA | TTCCCGA |
| hsa-miR-429 | UAAUACUGUCUGGUAAAACCGU | 592 | GACAGTATT | ACAGTATT | CAGTATT |

| microRNA | MicroRNASequence | SEQ ID NO | 9-mer Compound | 8-mer Compound | 7-mer Compound |
| --- | --- | --- | --- | --- | --- |
| hsa-miR-431 | UGUCUUGCAGGCCGUCAUGCA | 593 | CTGCAAGAC | TGCAAGAC | GCAAGAC |
| hsa-miR-431* | CAGGUCGUCUUGCAGGGCUUCU | 594 | AGACGACCT | GACGACCT | ACGACCT |
| hsa-miR-432 | UCUUGGAGUAGGUCAUUGGGUGG | 595 | TACTCCAAG | ACTCCAAG | CTCCAAG |
| hsa-miR-432* | CUGGAUGGCUCCUCCAUGUCU | 596 | AGCCATCCA | GCCATCCA | CCATCCA |
| hsa-miR-433 | AUCAUGAUGGGCUCCUCGGUGU | 597 | CCATCATGA | CATCATGA | ATCATGA |
| hsa-miR-448 | UUGCAUAUGUAGGAUGUCCCAU | 598 | ACATATGCA | CATATGCA | ATATGCA |
| hsa-miR-449a | UGGCAGUGUAUUGUUAGCUGGU | 599 | TACACTGCC | ACACTGCC | CACTGCC |
| hsa-miR-449b | AGGCAGUGUAUUGUUAGCUGGC | 600 | TACACTGCC | ACACTGCC | CACTGCC |
| hsa-miR-450a | UUUUGCGAUGUGUUCCUAAUAU | 601 | CATCGCAAA | ATCGCAAA | TCGCAAA |
| hsa-miR-450b-3p | UUGGGAUCAUUUUGCAUCCAUA | 602 | ATGATCCCA | TGATCCCA | GATCCCA |
| hsa-miR-450b-5p | UUUUGCAAUAUGUUCCUGAAUA | 603 | TATTGCAAA | ATTGCAAA | TTGCAAA |
| hsa-miR-451 | AAACCGUUACCAUUACUGAGUU | 604 | GTAACGGTT | TAACGGTT | AACGGTT |
| hsa-miR-452 | AACUGUUUGCAGAGGAAACUGA | 605 | GCAAACAGT | CAAACAGT | AAACAGT |
| hsa-miR-452* | CUCAUCUGCAAAGAAGUAAGUG | 606 | TGCAGATGA | GCAGATGA | CAGATGA |
| hsa-miR-453 | AGGUUGUCCGUGGUGAGUUCGCA | 607 | CGGACAACC | GGACAACC | GACAACC |
| hsa-miR-454 | UAGUGCAAUAUUGCUUAUAGGGU | 608 | TATTGCACT | ATTGCACT | TTGCACT |
| hsa-miR-454* | ACCCUAUCAAUAUUGUCUCUGC | 609 | TTGATAGGG | TGATAGGG | GATAGGG |
| hsa-miR-455-3p | GCAGUCCAUGGGCAUAUACAC | 610 | CATGGACTG | ATGGACTG | TGGACTG |
| hsa-miR-455-5p | UAUGUGCCUUUGGACUACAUCG | 611 | AAGGCACAT | AGGCACAT | GGCACAT |
| hsa-miR-483-3p | UCACUCCUCUCCUCCCGUCUU | 612 | AGAGGAGTG | GAGGAGTG | AGGAGTG |
| hsa-miR-483-5p | AAGACGGGAGGAAAGAAGGGAG | 613 | CTCCCGTCT | TCCCGTCT | CCCGTCT |
| hsa-miR-484 | UCAGGCUCAGUCCCCUCCCGAU | 614 | CTGAGCCTG | TGAGCCTG | GAGCCTG |
| hsa-miR-485-3p | GUCAUACACGGCUCUCCUCUCU | 615 | CGTGTATGA | GTGTATGA | TGTATGA |
| hsa-miR-485-5p | AGAGGCUGGCCGUGAUGAAUUC | 616 | GCCAGCCTC | CCAGCCTC | CAGCCTC |
| hsa-miR-486-3p | CGGGGCAGCUCAGUACAGGAU | 617 | AGCTGCCCC | GCTGCCCC | CTGCCCC |
| hsa-miR-486-5p | UCCUGUACUGAGCUGCCCCGAG | 618 | CAGTACAGG | AGTACAGG | GTACAGG |
| hsa miR-487a | AAUCAUACAGGGACAUCCAGUU | 619 | CTGTATGAT | TGTATGAT | GTATGAT |
| hsa-miR-487b | AAUCGUACAGGGUCAUCCACUU | 620 | CTGTACGAT | TGTACGAT | GTACGAT |
| hsa-miR-488 | UUGAAAGGCUAUUUCUUGGUC | 621 | AGCCTTTCA | GCCTTTCA | CCTTTCA |
| hsa-miR-488* | CCCAGAUAAUGGCACUCUCAA | 622 | ATTATCTGG | TTATCTGG | TATCTGG |
| hsa-miR-489 | GUGACAUCACAUAUACGGCAGC | 623 | GTGATGTCA | TGATGTCA | GATGTCA |
| hsa-miR-490-3p | CAACCUGGAGGACUCCAUGCUG | 624 | CTCCAGGTT | TCCAGGTT | CCAGGTT |
| hsa-miR-490-5p | CCAUGGAUCUCCAGGUGGGU | 625 | AGATCCATG | GATCCATG | ATCCATG |
| hsa-miR-491-3p | CUUAUGCAAGAUUCCCUUCUAC | 626 | CTTGCATAA | TTGCATAA | TGCATAA |
| hsa-miR-491-5p | AGUGGGGAACCCUUCCAUGAGG | 627 | GTTCCCCAC | TTCCCCAC | TCCCCAC |
| hsa-miR-492 | AGGACCUGCGGGACAAGAUUCUU | 628 | CGCAGGTCC | GCAGGTCC | CAGGTCC |
| nsa-miR-493 | UGAAGGUCUACUGUGUGCCAGG | 629 | TAGACCTTC | AGACCTTC | GACCTTC |
| hsa-miR-493* | UUGUACAUGGUAGGCUUUCAUU | 630 | CCATGTACA | CATGTACA | ATGTACA |

-continued

| microRNA | MicroRNASequence | SEQ ID NO | 9-mer Compound | 8-mer Compound | 7-mer Compound |
| --- | --- | --- | --- | --- | --- |
| hsa-miR-494 | UGAAACAUACACGGGAAACCUC | 631 | GTATGTTTC | TATGTTTC | ATGTTTC |
| hsa-miR-495 | AAACAAACAUGGUGCACUUCUU | 632 | ATGTTTGTT | TGTTTGTT | GTTTGTT |
| hsa-miR-496 | UGAGUAUUACAUGGCCAAUCUC | 633 | GTAATACTC | TAATACTC | AATACTC |
| hsa-miR-497 | CAGCAGCACACUGUGGUUUGU | 634 | TGTGCTGCT | GTGCTGCT | TGCTGCT |
| hsa-miR-497* | CAAACCACACUGUGGUGUUAGA | 635 | GTGTGGTTT | TGTGGTTT | GTGGTTT |
| hsa-miR-498 | UUUCAAGCCAGGGGGCGUUUUC | 636 | TGGCTTGAA | GGCTTGAA | GCTTGAA |
| hsa-miR-499-3p | AACAUCACAGCAAGUCUGUGCU | 637 | CTGTGATGT | TGTGATGT | GTGATGT |
| hsa-miR-499-5p | UUAAGACUUGCAGUGAUGUUU | 638 | CAAGTCTTA | AAGTCTTA | AGTCTTA |
| hsa-miR-500 | UAAUCCUUGCUACCUGGGUGAGA | 639 | GCAAGGATT | CAAGGATT | AAGGATT |
| hsa-miR-500* | AUGCACCUGGGCAAGGAUUCUG | 640 | CCAGGTGCA | CAGGTGCA | AGGTGCA |
| hsa-miR-501-3p | AAUGCACCCGGGCAAGGAUUCU | 641 | CGGGTGCAT | GGGTGCAT | GGTGCAT |
| hsa-miR-501-5p | AAUCCUUUGUCCCUGGGUGAGA | 642 | ACAAAGGAT | CAAAGGAT | AAAGGAT |
| hsa-miR-502-3p | AAUGCACCUGGGCAAGGAUUCA | 643 | CAGGTGCAT | AGGTGCAT | GGTGCAT |
| hsa-miR-502-5p | AUCCUUGCUAUCUGGGUGCUA | 644 | TAGCAAGGA | AGCAAGGA | GCAAGGA |
| hsa-miR-503 | UAGCAGCGGGAACAGUUCUGCAG | 645 | CCCGCTGCT | CCGCTGCT | CGCTGCT |
| hsa-miR-504 | AGACCCUGGUCUGCACUCUAUC | 646 | ACCAGGGTC | CCAGGGTC | CAGGGTC |
| hsa-miR-505 | CGUCAACACUUGCUGGUUUCCU | 647 | AGTGTTGAC | GTGTTGAC | TGTTGAC |
| hsa-miR-505* | GGGAGCCAGGAAGUAUUGAUGU | 648 | CCTGGCTCC | CTGGCTCC | TGGCTCC |
| hsa-miR-506 | UAAGGCACCCUUCUGAGUAGA | 649 | GGGTGCCTT | GGTGCCTT | GTGCCTT |
| hsa-miR-507 | UUUUGCACCUUUUGGAGUGAA | 650 | AGGTGCAAA | GGTGCAAA | GTGCAAA |
| hsa-miR-508-3p | UGAUUGUAGCCUUUUGGAGUAGA | 651 | GCTACAATC | CTACAATC | TACAATC |
| hsa-miR-508-5p | UACUCCAGAGGGCGUCACUCAUG | 652 | CTCTGGAGT | TCTGGAGT | CTGGAGT |
| hsa-miR-509-3-5p | UACUGCAGACGUGGCAAUCAUG | 653 | GTCTGCAGT | TCTGCAGT | CTGCAGT |
| hsa-miR-509-3p | UGAUUGGUACGUCUGUGGGUAG | 654 | GTACCAATC | TACCAATC | ACCAATC |
| hsa-miR-509-5p | UACUGCAGACAGUGGCAAUCA | 655 | GTCTGCAGT | TCTGCAGT | CTGCAGT |
| hsa-miR-510 | UACUCAGGAGAGUGGCAAUCAC | 656 | CTCCTGAGT | TCCTGAGT | CCTGAGT |
| hsa-miR-511 | GUGUCUUUUGCUCUGCAGUCA | 657 | CAAAAGACA | AAAAGACA | AAAGACA |
| hsa-miR-512-3p | AAGUGCUGUCAUAGCUGAGGUC | 658 | GACAGCACT | ACAGCACT | CAGCACT |
| hsa-miR-512-5p | CACUCAGCCUUGAGGGCACUUUC | 659 | AGGCTGAGT | GGCTGAGT | GCTGAGT |
| hsa-miR-513a-3p | UAAAUUUCACCUUUCUGAGAAGG | 660 | GTGAAATTT | TGAAATTT | GAAATTT |
| hsa-miR-513a-5p | UUCACAGGGAGGUGUCAU | 661 | TCCCTGTGA | CCCTGTGA | CCTGTGA |
| hsa-miR-513b | UUCACAAGGAGGUGUCAUUUAU | 662 | TCCTTGTGA | CCTTGTGA | CTTGTGA |
| hsa-miR-513c | UUCUCAAGGAGGUGUCGUUUAU | 663 | TCCTTGAGA | CCTTGAGA | CTTGAGA |
| hsa-miR-514 | AUUGACACUUCUGUGAGUAGA | 664 | AAGTGTCAA | AGTGTCAA | GTGTCAA |
| hsa-miR-515-3p | GAGUGCCUUCUUUUGGAGCGUU | 665 | GAAGGCACT | AAGGCACT | AGGCACT |
| hsa-miR-515-5p | UUCUCCAAAAGAAAGCACUUUCUG | 666 | TTTTGGAGA | TTTGGAGA | TTGGAGA |
| hsa-miR-516a-3p | UGCUUCCUUUCAGAGGGU | 667 | AAAGGAAGC | AAGGAAGC | AGGAAGC |
| hsa-miR-516a-5p | UUCUCGAGGAAAGAAGCACUUUC | 668 | TCCTCGAGA | CCTCGAGA | CTCGAGA |

-continued

| microRNA | MicroRNASequence | SEQ ID NO | 9-mer Compound | 8-mer Compound | 7-mer Compound |
|---|---|---|---|---|---|
| hsa-miR-516b | AUCUGGAGGUAAGAAGCACUUU | 669 | ACCTCCAGA | CCTCCAGA | CTCCAGA |
| hsa-miR-517* | CCUCUAGAUGGAAGCACUGUCU | 670 | CATCTAGAG | ATCTAGAG | TCTAGAG |
| hsa-miR-517a | AUCGUGCAUCCCUUUAGAGUGU | 671 | GATGCACGA | ATGCACGA | TGCACGA |
| hsa-miR-517b | UCGUGCAUCCCUUUAGAGUGUU | 672 | GGATGCACG | GATGCACG | ATGCACG |
| hsa-miR-517c | AUCGUGCAUCCUUUUAGAGUGU | 673 | GATGCACGA | ATGCACGA | TGCACGA |
| hsa miR-518A-3p | GAAAGCGCUUCCCUUUGCUGGA | 674 | AAGCGCTTT | AGCGCTTT | GCGCTTT |
| hsa-miR-518b | CAAAGCGCUCCCCUUUAGAGGU | 675 | GAGCGCTTT | AGCGCTTT | GCGCTTT |
| hsa-miR-518c | CAAAGCGCUUCUCUUUAGAGUGU | 676 | AAGCGCTTT | AGCGCTTT | GCGCTTT |
| hsa-miR-518c* | UCUCUGGAGGGAAGCACUUUCUG | 677 | CCTCCAGAG | CTCCAGAG | TCCAGAG |
| hsa-miR-518d-3p | CAAAGCGCUUCCCUUUGGAGC | 678 | AAGCGCTTT | AGCGCTTT | GCGCTTT |
| hsa-miR-518d-5p | CUCUAGAGGGAAGCACUUUCUG | 679 | CCCTCTAGA | CCTCTAGA | CTCTAGA |
| hsa-miR-518e | AAAGCGCUUCCCUUCAGAGUG | 680 | GAAGCGCTT | AAGCGCTT | AGCGCTT |
| hsa-miR-518f | GAAAGCGCUUCUCUUUAGAGG | 681 | AAGCGCTTT | AGCGCTTT | GCGCTTT |
| hsa-miR-518f* | CUCUAGAGGGAAGCACUUUCUC | 682 | CCCTCTAGA | CCTCTAGA | CTCTAGA |
| hsa-miR-519a | AAAGUGCAUCCUUUUAGAGUGU | 683 | GATGCACTT | ATGCACTT | TGCACTT |
| nsa-miR-519a* | CUCUAGAGGGAAGCGCUUUCUG | 684 | CCCTCTAGA | CCTCTAGA | CTCTAGA |
| hsa-miR-519b-3p | AAAGUGCAUCCUUUUAGAGGUU | 685 | GATGCACTT | ATGCACTT | TGCACTT |
| hsa-miR-519c-3p | AAAGUGCAUCUUUUUAGAGGAU | 686 | GATGCACTT | ATGCACTT | TGCACTT |
| hsa-miR-519d | CAAAGUGCCUCCCUUUAGAGUG | 687 | AGGCACTTT | GGCACTTT | GCACTTT |
| hsa-miR-519e | AAGUGCCUCCUUUUAGAGUGUU | 688 | GGAGGCACT | GAGGCACT | AGGCACT |
| hsa-miR-519e* | UUCUCCAAAAGGGAGCACUUUC | 689 | TTTTGGAGA | TTTGGAGA | TTGGAGA |
| hsa-miR-520a-3p | AAAGUGCUUCCCUUUGGACUGU | 690 | GAAGCACTT | AAGCACTT | AGCACTT |
| hsa-miR-520a-5p | CUCCAGAGGGAAGUACUUUCU | 691 | CCCTCTGGA | CCTCTGGA | CTCTGGA |
| hsa-miR-520b | AAAGUGCUUCCUUUUAGAGGG | 692 | GAAGCACTT | AAGCACTT | AGCACTT |
| hsa-miR-520c-3p | AAAGUGCUUCCUUUUAGAGGGU | 693 | GAAGCACTT | AAGCACTT | AGCACTT |
| hsa-miR-520d-3p | AAAGUGCUUCUCUUUGGUGGGU | 694 | GAAGCACTT | AAGCACTT | AGCACTT |
| hsa-miR-520d-5p | CUACAAAGGGAAGCCCUUUC | 695 | CCCTTTGTA | CCTTTGTA | CTTTGTA |
| hsa-miR-520e | AAAGUGCUUCCUUUUUGAGGG | 696 | GAAGCACTT | AAGCACTT | AGCACTT |
| hsa-miR-520f | AAGUGCUUCCUUUUAGAGGGUU | 697 | GGAAGCACT | GAAGCACT | AAGCACT |
| hsa-miR-520g | ACAAAGUGCUUCCCUUUAGAGUGU | 698 | AGCACTTTG | GCACTTTG | CACTTTG |
| hsa-miR-520h | ACAAAGUGCUUCCCUUUAGAGU | 699 | AGCACTTTG | GCACTTTG | CACTTTG |
| hsa-miR-521 | AACGCACUUCCCUUUAGAGUGU | 700 | GAAGTGCGT | AAGTGCGT | AGTGCGT |
| hsa-miR-522 | AAAAUGGUUCCCUUUAGAGUGU | 701 | GAACCATTT | AACCATTT | ACCATTT |
| hsa-miR-523 | GAACGCGCUUCCCUAUAGAGGGU | 702 | AAGCGCGTT | AGCGCGTT | GCGCGTT |
| hsa-miR-524-3p | GAAGGCGCUUCCCUUUGGAGU | 703 | AAGCGCCTT | AGCGCCTT | GCGCCTT |
| hsa-miR-524-5p | CUACAAAGGGAAGCACUUUCUC | 704 | CCCTTTGTA | CCTTTGTA | CTTTGTA |
| hsa-miR-525-3p | GAAGGCGCUUCCCUUUAGAGCG | 705 | AAGCGCCTT | AGCGCCTT | GCGCCTT |
| hsa-miR-525-5p | CUCCAGAGGGAUGCACUUUCU | 706 | CCCTCTGGA | CCTCTGGA | CTCTGGA |

-continued

| microRNA | MicroRNASequence | SEQ ID NO | 9-mer Compound | 8-mer Compound | 7-mer Compound |
|---|---|---|---|---|---|
| hsa-miR-526b | CUCUUGAGGGAAGCACUUUCUGU | 707 | CCCTCAAGA | CCTCAAGA | CTCAAGA |
| hsa-miR-526b* | GAAAGUGCUUCCUUUUAGAGGC | 708 | AAGCACTTT | AGCACTTT | GCACTTT |
| hsa-miR-527 | CUGCAAAGGGAAGCCCUUUC | 709 | CCCTTTGCA | CCTTTGCA | CTTTGCA |
| hsa-miR-532-3p | CCUCCCACACCCAAGGCUUGCA | 710 | GTGTGGGAG | TGTGGGAG | GTGGGAG |
| hsa-miR-532-5p | CAUGCCUUGAGUGUAGGACCGU | 711 | TCAAGGCAT | CAAGGCAT | AAGGCAT |
| hsa-miR-539 | GGAGAAAUUAUCCUUGGUGUGU | 712 | TAATTTCTC | AATTTCTC | ATTTCTC |
| hsa-miR-541 | UGGUGGGCACAGAAUCUGGACU | 713 | GTGCCCACC | TGCCCACC | GCCCACC |
| hsa-miR-541* | AAAGGAUUCUGCUGUCGGUCCCACU | 714 | AGAATCCTT | GAATCCTT | AATCCTT |
| hsa-miR-542-3p | UGUGACAGAUUGAUAACUGAAA | 715 | ATCTGTCAC | TCTGTCAC | CTGTCAC |
| hsa-miR-542-5p | UCGGGAUCAUCAUGUCACGAGA | 716 | TGATCCCCG | GATCCCCG | ATCCCCG |
| hsa-miR-543 | AAACAUUCGCGGUGCACUUCUU | 717 | GCGAATGTT | CGAATGTT | GAATGTT |
| hsa-miR-544 | AUUCUGCAUUUUUAGCAAGUUC | 718 | AATGCAGAA | ATGCAGAA | TGCAGAA |
| hsa-miR-545 | UCAGCAAACAUUUAUUGUGUGC | 719 | TGTTTGCTG | GTTTGCTG | TTTGCTG |
| hsa-miR-545* | UCAGUAAAUGUUUAUUAGAUGA | 720 | CATTTACTG | ATTTACTG | TTTACTG |
| hsa-miR-548a-3p | CAAAACUGGCAAUUACUUUUGC | 721 | GCCAGTTTT | CCAGTTTT | CAGTTTT |
| hsa-miR-548a-5p | AAAAGUAAUUGCGAGUUUUACC | 722 | AATTACTTT | ATTACTTT | TTACTTT |
| hsa-miR-548b-3p | CAAGAACCUCAGUUGCUUUUGU | 723 | GAGGTTCTT | AGGTTCTT | GGTTCTT |
| hsa-miR-548b-5p | AAAAGUAAUUGUGGUUUUGGCC | 724 | AATTACTTT | ATTACTTT | TTACTTT |
| hsa-miR-548c-3p | CAAAAAUCUCAAUUACUUUUGC | 725 | GAGATTTTT | AGATTTTT | GATTTTT |
| hsa-miR-548c-5p | AAAAGUAAUUGCGGUUUUUGCC | 726 | AATTACTTT | ATTACTTT | TTACTTT |
| hsa-miR-548d-3p | CAAAAACCACAGUUUCUUUUGC | 727 | GTGGTTTTT | TGGTTTTT | GGTTTTT |
| hsa-miR-548d-5p | AAAAGUAAUUGUGGUUUUUGCC | 728 | AATTACTTT | ATTACTTT | TTACTTT |
| hsa miR-548e | AAAAACUGAGACUACUUUUGCA | 729 | CTCAGTTTT | TCAGTTTT | CAGTTTT |
| hsa-miR-548f | AAAAACUGUAAUUACUUUU | 730 | TACAGTTTT | ACAGTTTT | CAGTTTT |
| hsa-miR-548g | AAAACUGUAAUUACUUUUGUAC | 731 | TTACAGTTT | TACAGTTT | ACAGTTT |
| hsa-miR-548h | AAAAGUAAUCGCGGUUUUUGUC | 732 | GATTACTTT | ATTACTTT | TTACTTT |
| hsa-miR-548i | AAAAGUAAUUGCGGAUUUUGCC | 733 | AATTACTTT | ATTACTTT | TTACTTT |
| hsa-miR-548j | AAAAGUAAUUGCGGUCUUUGGU | 734 | AATTACTTT | ATTACTTT | TTACTTT |
| hsa-miR-548k | AAAAGUACUUGCGGAUUUUGCU | 735 | AAGTACTTT | AGTACTTT | GTACTTT |
| hsa-miR-548l | AAAAGUAUUUGCGGGUUUUGUC | 736 | AAATACTTT | AATACTTT | ATACTTT |
| hsa-miR-548m | CAAAGGUAUUUGUGGUUUUUG | 737 | AATACCTTT | ATACCTTT | TACCTTT |
| hsa-miR-548n | CAAAAGUAAUUGUGGAUUUUGU | 738 | ATTACTTTT | TTACTTTT | TACTTTT |
| nsa-miR-548o | CCAAAACUGCAGUUACUUUUGC | 739 | GCAGTTTTG | CAGTTTTG | AGTTTTG |
| hsa-miR-548p | UAGCAAAAACUGCAGUUACUUU | 740 | GTTTTGCT | TTTTTGCT | TTTTGCT |
| hsa-miR-549 | UGACAACUAUGGAUGAGCUCU | 741 | ATAGTTGTC | TAGTTGTC | AGTTGTC |
| hsa-miR-550 | AGUGCCUGAGGGAGUAAGAGCCC | 742 | CTCAGGCAC | TCAGGCAC | CAGGCAC |
| hsa-miR-550* | UGUCUUACUCCCUCAGGCACAU | 743 | GAGTAAGAC | AGTAAGAC | GTAAGAC |
| hsa-miR-551a | GCGACCCACUCUUGGUUUCCA | 744 | AGTGGGTCG | GTGGGTCG | TGGGTCG |

-continued

| microRNA | MicroRNASequence | SEQ ID NO | 9-mer Compound | 8-mer Compound | 7-mer Compound |
|---|---|---|---|---|---|
| hsa-miR-551b | GCGACCCAUACUUGGUUUCAG | 745 | TATGGGTCG | ATGGGTCG | TGGGTCG |
| hsa-miR-551b* | GAAAUCAAGCGUGGGUGAGACC | 746 | GCTTGATTT | CTTGATTT | TTGATTT |
| hsa-miR-552 | AACAGGUGACUGGUUAGACAA | 747 | GTCACCTGT | TCACCTGT | CACCTGT |
| hsa-miR-553 | AAAACGGUGAGAUUUUGUUUU | 748 | TCACCGTTT | CACCGTTT | ACCGTTT |
| hsa-miR-554 | GCUAGUCCUGACUCAGCCAGU | 749 | CAGGACTAG | AGGACTAG | GGACTAG |
| hsa-miR-555 | AGGGUAAGCUGAACCUCUGAU | 750 | AGCTTACCC | GCTTACCC | CTTACCC |
| hsa-miR-556-3p | AUAUUACCAUUAGCUCAUCUUU | 751 | ATGGTAATA | TGGTAATA | GGTAATA |
| hsa-miR-556-5p | GAUGAGCUCAUUGUAAUAUGAG | 752 | TGAGCTCAT | GAGCTCAT | AGCTCAT |
| hsa-miR-557 | GUUUGCACGGGUGGGCCUUGUCU | 753 | CCGTGCAAA | CGTGCAAA | GTGCAAA |
| hsa-miR-558 | UGAGCUGCUGUACCAAAAU | 754 | CAGCAGCTC | AGCAGCTC | GCAGCTC |
| hsa-miR-559 | UAAAGUAAAUAUGCACCAAAA | 755 | ATTTACTTT | TTTACTTT | TTACTTT |
| hsa-miR-561 | CAAAGUUUAAGAUCCUUGAAGU | 756 | TTAAACTTT | TAAACTTT | AAACTTT |
| hsa-miR-562 | AAAGUAGCUGUACCAUUUGC | 757 | CAGCTACTT | AGCTACTT | GCTACTT |
| hsa-miR-563 | AGGUUGACAUACGUUUCCC | 758 | ATGTCAACC | TGTCAACC | GTCAACC |
| hsa-miR-564 | AGGCACGGUGUCAGCAGGC | 759 | CACCGTGCC | ACCGTGCC | CCGTGCC |
| hsa-miR-566 | GGGCGCCUGUGAUCCCAAC | 760 | ACAGGCGCC | CAGGCGCC | AGGCGCC |
| hsa-miR-567 | AGUAUGUUCUUCCAGGACAGAAC | 761 | AGAACATAC | GAACATAC | AACATAC |
| hsa-miR-568 | AUGUAUAAAUGUAUACACAC | 762 | ATTTATACA | TTTATACA | TTATACA |
| hsa-miR-569 | AGUUAAUGAAUCCUGGAAAGU | 763 | TTCATTAAC | TCATTAAC | CATTAAC |
| hsa-miR-570 | CGAAAACAGCAAUUACCUUUGC | 764 | GCTGTTTTC | CTGTTTTC | TGTTTTC |
| hsa-miR-571 | UGAGUUGGCCAUCUGAGUGAG | 765 | GGCCAACTC | GCCAACTC | CCAACTC |
| hsa-miR-572 | GUCCGCUCGGCGGUGGCCCA | 766 | CCGAGCGGA | CGAGCGGA | GAGCGGA |
| hsa-miR-573 | CUGAAGUGAUGUGUAACUGAUCAG | 767 | ATCACTTCA | TCACTTCA | CACTTCA |
| hsa-miR-574-3p | CACGCUCAUGCACACACCCACA | 768 | CATGAGCGT | ATGAGCGT | TGAGCGT |
| hsa-miR-474-5p | UGAGUGUGUGUGUGUGAGUGUGU | 769 | CACACACTC | ACACACTC | CACACTC |
| hsa-miR-575 | GAGCCAGUUGGACAGGAGC | 770 | CAACTGGCT | AACTGGCT | ACTGGCT |
| hsa-miR-576-3p | AAGAUGUGGAAAAAUUGGAAUC | 771 | TCCACATCT | CCACATCT | CACATCT |
| hsa-miR-576-5p | AUUCUAAUUUCUCCACGUCUUU | 772 | AAATTAGAA | AATTAGAA | ATTAGAA |
| hsa-miR-577 | UAGAUAAAAUAUUGGUACCUG | 773 | ATTTTATCT | TTTTATCT | TTTATCT |
| hsa-miR-578 | CUUCUUGUGCUCUAGGAUUGU | 774 | GCACAAGAA | CACAAGAA | ACAAGAA |
| hsa-miR-579 | UUCAUUUGGUAUAAACCGCGAUU | 775 | ACCAAATGA | CCAAATGA | CAAATGA |
| hsa-miR-580 | UUGAGAAUGAUGAAUCAUUAGG | 776 | TCATTCTCA | CATTCTCA | ATTCTCA |
| hsa-miR-581 | UCUUGUGUUCUCUAGAUCAGU | 777 | GAACACAAG | AACACAAG | ACACAAG |
| hsa-miR-582-3p | UAACUGGUUGAACAACUGAACC | 778 | CAACCAGTT | AACCAGTT | ACCAGTT |
| hsa-miR-582-5p | UUACAGUUGUUCAACCAGUUACU | 779 | ACAACTGTA | CAACTGTA | AACTGTA |
| hsa-miR-583 | CAAAGAGGAAGGUCCCAUUAC | 780 | TTCCTCTTT | TCCTCTTT | CCTCTTT |
| hsa-miR-584 | UUAUGGUUUGCCUGGGACUGAG | 781 | CAAACCATA | AAACCATA | AACCATA |
| hsa-miR-585 | UGGGCGUAUCUGUAUGCUA | 782 | GATACGCCC | ATACGCCC | TACGCCC |

-continued

| microRNA | MicroRNASequence | SEQ ID NO | 9-mer Compound | 8-mer Compound | 7-mer Compound |
|---|---|---|---|---|---|
| hsa-miR-586 | UAUGCAUUGUAUUUUAGGUCC | 783 | ACAATGCAT | CAATGCAT | AATGCAT |
| hsa miR-587 | UUUCCAUAGGUGAUGAGUCAC | 784 | CCTATGGAA | CTATGGAA | TATGGAA |
| hsa-miR-588 | UUGGCCACAAUGGGUUAGAAC | 785 | TTGTGGCCA | TGTGGCCA | GTGGCCA |
| hsa-miR-589 | UGAGAACCACGUCUGCUCUGAG | 786 | GTGGTTCTC | TGGTTCTC | GGTTCTC |
| hsa-miR-589* | UCAGAACAAAUGCCGGUUCCCAGA | 787 | TTTGTTCTG | TTGTTCTG | TGTTCTG |
| hsa-miR-590-3p | UAAUUUUAUGUAUAAGCUAGU | 788 | CATAAAATT | ATAAAATT | TAAAATT |
| hsa-miR-590-5p | GAGCUUAUUCAUAAAAGUGCAG | 789 | GAATAAGCT | AATAAGCT | ATAAGCT |
| hsa-miR-591 | AGACCAUGGGUUCUCAUUGU | 790 | CCCATGGTC | CCATGGTC | CATGGTC |
| hsa-miR-592 | UUGUGUCAAUAUGCGAUGAUGU | 791 | ATTGACACA | TTGACACA | TGACACA |
| hsa-miR-593 | UGUCUCUGCUGGGGUUUCU | 792 | AGCAGAGAC | GCAGAGAC | CAGAGAC |
| hsa-miR-593* | AGGCACCAGCCAGGCAUUGCUCAGC | 793 | GCTGGTGCC | CTGGTGCC | TGGTGCC |
| hsa-miR-595 | GAAGUGUGCCGUGGUGUGUCU | 794 | GGCACACTT | GCACACTT | CACACTT |
| hsa-miR-596 | AAGCCUGCCCGGCUCCUCGGG | 795 | GGGCAGGCT | GGCAGGCT | GCAGGCT |
| hsa-miR-597 | UGUGUCACUCGAUGACCACUGU | 796 | GAGTGACAC | AGTGACAC | GTGACAC |
| hsa-miR-598 | UACGUCAUCGUUGUCAUCGUCA | 797 | CGATGACGT | GATGACGT | ATGACGT |
| hsa-miR-599 | GUUGUGUCAGUUUAUCAAAC | 798 | CTGACACAA | TGACACAA | GACACAA |
| hsa-miR-600 | ACUUACAGACAAGAGCCUUGCUC | 799 | GTCTGTAAG | TCTGTAAG | CTGTAAG |
| hsa-miR-601 | UGGUCUAGGAUUGUUGGAGGAG | 800 | TCCTAGACC | CCTAGACC | CTAGACC |
| hsa-miR-602 | GACACGGGCGACAGCUGCGGCCC | 801 | CGCCCGTGT | GCCCGTGT | CCCGTGT |
| hsa-miR-603 | CACACACUGCAAUUACUUUUGC | 802 | GCAGTGTGT | CAGTGTGT | AGTGTGT |
| hsa-miR-604 | AGGCUGCGGAAUUCAGGAC | 803 | TCCGCAGCC | CCGCAGCC | CGCAGCC |
| hsa-miR-605 | UAAAUCCCAUGGUGCCUUCUCCU | 804 | ATGGGATTT | TGGGATTT | GGGATTT |
| hsa-miR-606 | AAACUACUGAAAAUCAAAGAU | 805 | TCAGTAGTT | CAGTAGTT | AGTAGTT |
| hsa-miR-607 | GUUCAAAUCCAGAUCUAUAAC | 806 | GGATTTGAA | GATTTGAA | ATTTGAA |
| hsa-miR-608 | AGGGGUGGUGUUGGGACAGCUCCGU | 807 | CACCACCCC | ACCACCCC | CCACCCC |
| hsa-miR-609 | AGGGUGUUUCUCUCAUCUCU | 808 | GAAACACCC | AAACACCC | AACACCC |
| hsa-miR-610 | UGAGCUAAAUGUGUGCUGGGA | 809 | ATTTAGCTC | TTTAGCTC | TTAGCTC |
| hsa-miR-611 | GCGAGGACCCCUCGGGGUCUGAC | 810 | GGGTCCTCG | GGTCCTCG | GTCCTCG |
| hsa-miR-612 | GCUGGGCAGGGCUUCUGAGCUCCUU | 811 | CCTGCCCAG | CTGCCCAG | TGCCCAG |
| hsa-miR-613 | AGGAAUGUUCCUUCUUUGCC | 812 | GAACATTCC | AACATTCC | ACATTCC |
| hsa-miR-614 | GAACGCCUGUUCUUGCCAGGUGG | 813 | ACAGGCGTT | CAGGCGTT | AGGCGTT |
| hsa-miR-615-3p | UCCGAGCCUGGGUCUCCCUCUU | 814 | CAGGCTCGG | AGGCTCGG | GGCTCGG |
| hsa-miR-615-5p | GGGGGUCCCCGGUGCUCGGAUC | 815 | GGGGACCCC | GGGACCCC | GGACCCC |
| hsa-miR-616 | AGUCAUUGGAGGGUUUGAGCAG | 816 | TCCAATGAC | CCAATGAC | CAATGAC |
| hsa-miR-616* | ACUCAAAACCCUUCAGUGACUU | 817 | GGTTTTGAG | GTTTTGAG | TTTTGAG |
| hsa-miR-617 | AGACUUCCCAUUUGAAGGUGGC | 818 | TGGGAAGTC | GGGAAGTC | GGAAGTC |
| hsa-miR-618 | AAACUCUACUUGUCCUUCUGAGU | 819 | AGTAGAGTT | GTAGAGTT | TAGAGTT |
| hsa-miR-619 | GACCUGGACAUGUUUGUGCCCAGU | 820 | TGTCCAGGT | GTCCAGGT | TCCAGGT |

-continued

| microRNA | MicroRNASequence | SEQ ID NO | 9-mer Compound | 8-mer Compound | 7-mer Compound |
|---|---|---|---|---|---|
| hsa-miR-620 | AUGGAGAUAGAUAUAGAAAU | 821 | CTATCTCCA | TATCTCCA | ATCTCCA |
| hsa-miR-621 | GGCUAGCAACAGCGCUUACCU | 822 | GTTGCTAGC | TTGCTAGC | TGCTAGC |
| hsa-miR-622 | ACAGUCUGCUGAGGUUGGAGC | 823 | AGCAGACTG | GCAGACTG | CAGACTG |
| hsa-miR-623 | AUCCCUUGCAGGGGCUGUUGGGU | 824 | TGCAAGGGA | GCAAGGGA | CAAGGGA |
| hsa-miR-624 | CACAAGGUAUUGGUAUUACCU | 825 | ATACCTTGT | TACCTTGT | ACCTTGT |
| hsa-miR-624* | UAGUACCAGUACCUUGUGUUCA | 826 | ACTGGTACT | CTGGTACT | TGGTACT |
| hsa-miR-625 | AGGGGGAAAGUUCUAUAGUCC | 827 | CTTTCCCCC | TTTCCCCC | TTCCCCC |
| hsa-miR-625* | GACUAUAGAACUUUCCCCCUCA | 828 | TTCTATAGT | TCTATAGT | CTATAGT |
| hsa-miR-626 | AGCUGUCUGAAAAUGUCUU | 829 | TCAGACAGC | CAGACAGC | AGACAGC |
| hsa-miR-627 | GUGAGUCUCUAAGAAAAGAGGA | 830 | AGAGACTCA | GAGACTCA | AGACTCA |
| hsa-miR-628-3p | UCUAGUAAGAGUGGCAGUCGA | 831 | TCTTACTAG | CTTACTAG | TTACTAG |
| hsa-miR-628-5p | AUGCUGACAUAUUUACUAGAGG | 832 | ATGTCAGCA | TGTCAGCA | GTCAGCA |
| hsa-miR-629 | UGGGUUUACGUUGGGAGAACU | 833 | CGTAAACCC | GTAAACCC | TAAACCC |
| hsa-miR-629* | GUUCUCCCAACGUAAGCCCAGC | 834 | TTGGGAGAA | TGGGAGAA | GGGAGAA |
| hsa-miR-630 | AGUAUUCUGUACCAGGGAAGGU | 835 | ACAGAATAC | CAGAATAC | AGAATAC |
| hsa-miR-631 | AGACCUGGCCCAGACCUCAGC | 836 | GGCCAGGTC | GCCAGGTC | CCAGGTC |
| hsa-miR-632 | GUGUCUGCUUCCUGUGGGA | 837 | AAGCAGACA | AGCAGACA | GCAGACA |
| hsa-miR-633 | CUAAUAGUAUCUACCACAAUAAA | 838 | ATACTATTA | TACTATTA | ACTATTA |
| hsa-miR-634 | AACCAGCACCCCAACUUUGGAC | 839 | GGTGCTGGT | GTGCTGGT | TGCTGGT |
| hsa-miR-635 | ACUUGGGCACUGAAACAAUGUCC | 840 | GTGCCCAAG | TGCCCAAG | GCCCAAG |
| hsa-miR-636 | UGUGCUUGCUCGUCCCGCCCGCA | 841 | AGCAAGCAC | GCAAGCAC | CAAGCAC |
| hsa-miR-637 | ACUGGGGGCUUUCGGGCUCUGCGU | 842 | AGCCCCCAG | GCCCCCAG | CCCCCAG |
| hsa-miR-638 | AGGGAUCGCGGGCGGGUGGCGGCCU | 843 | CGCGATCCC | GCGATCCC | CGATCCC |
| hsa-miR-639 | AUCGCUGCGGUUGCGAGCGCUGU | 844 | CCGCAGCGA | CGCAGCGA | GCAGCGA |
| hsa-miR-640 | AUGAUCCAGGAACCUGCCUCU | 845 | CCTGGATCA | CTGGATCA | TGGATCA |
| hsa-miR-641 | AAAGACAUAGGAUAGAGUCACCUC | 846 | CTATGTCTT | TATGTCTT | ATGTCTT |
| hsa-miR-642 | GUCCCUCUCCAAAUGUGUCUUG | 847 | GGAGAGGGA | GAGAGGGA | AGAGGGA |
| hsa-miR-643 | ACUUGUAUGCUAGCUCAGGUAG | 848 | GCATACAAG | CATACAAG | ATACAAG |
| hsa-miR-644 | AGUGUGGCUUUCUUAGAGC | 849 | AAGCCACAC | AGCCACAC | GCCACAC |
| hsa-miR-645 | UCUAGGCUGGUACUGCUGA | 850 | CCAGCCTAG | CAGCCTAG | AGCCTAG |
| hsa-miR-646 | AAGCAGCUGCCUCUGAGGC | 851 | GCAGCTGCT | CAGCTGCT | AGCTGCT |
| hsa-miR-647 | GUGGCUGCACUCACUUCCUUC | 852 | GTGCAGCCA | TGCAGCCA | GCAGCCA |
| hsa-miR-648 | AAGUGUGCAGGGCACUGGU | 853 | CTGCACACT | TGCACACT | GCACACT |
| hsa-miR-649 | AAACCUGUGUUGUUCAAGAGUC | 854 | ACACAGGTT | CACAGGTT | ACAGGTT |
| hsa-miR-650 | AGGAGGCAGCGCUCUCAGGAC | 855 | GCTGCCTCC | CTGCCTCC | TGCCTCC |
| hsa-miR-651 | UUUAGGAUAAGCUUGACUUUUG | 856 | TTATCCTAA | TATCCTAA | ATCCTAA |
| hsa-miR-652 | AAUGGCGCCACUAGGGUUGUG | 857 | TGGCGCCAT | GGCGCCAT | GCGCCAT |
| hsa-miR-653 | GUGUUGAAACAAUCUCUACUG | 858 | GTTTCAACA | TTTCAACA | TTCAACA |

-continued

| microRNA | MicroRNASequence | SEQ ID NO | 9-mer Compound | 8-mer Compound | 7-mer Compound |
|---|---|---|---|---|---|
| hsa-miR-654-3p | UAUGUCUGCUGACCAUCACCUU | 859 | AGCAGACAT | GCAGACAT | CAGACAT |
| hsa-miR-654-5p | UGGUGGGCCGCAGAACAUGUGC | 860 | CGGCCCACC | GGCCCACC | GCCCACC |
| hsa-miR-655 | AUAAUACAUGGUUAACCUCUUU | 861 | CATGTATTA | ATGTATTA | TGTATTA |
| hsa-miR-656 | AAUAUUAUACAGUCAACCUCU | 862 | GTATAATAT | TATAATAT | ATAATAT |
| hsa-miR-657 | GGCAGGUUCUCACCCUCUCUAGG | 863 | AGAACCTGC | GAACCTGC | AACCTGC |
| hsa-miR-658 | GGCGGAGGGAAGUAGGUCCGUUGGU | 864 | TCCCTCCGC | CCCTCCGC | CCTCCGC |
| hsa-miR-659 | CUUGGUUCAGGGAGGGUCCCCA | 865 | CTGAACCAA | TGAACCAA | GAACCAA |
| hsa-miR-660 | UACCCAUUGCAUAUCGGAGUUG | 866 | GCAATGGGT | CAATGGGT | AATGGGT |
| hsa-miR-661 | UGCCUGGGUCUCUGGCCUGCGCGU | 867 | GACCCAGGC | ACCCAGGC | CCCAGGC |
| hsa-miR-662 | UCCCACGUUGUGGCCCAGCAG | 868 | CAACGTGGG | AACGTGGG | ACGTGGG |
| hsa-miR-663 | AGGCGGGGCGCCGCGGGACCGC | 869 | CGCCCCGCC | GCCCCGCC | CCCCGCC |
| hsa-miR-663b | GGUGGCCCGGCCGUGCCUGAGG | 870 | CCGGGCCAC | CGGGCCAC | GGGCCAC |
| hsa-miR-664 | UAUUCAUUUAUCCCCAGCCUACA | 871 | TAAATGAAT | AAATGAAT | AATGAAT |
| hsa-miR-664* | ACUGGCUAGGGAAAAUGAUUGGAU | 872 | CCTAGCCAG | CTAGCCAG | TAGCCAG |
| hsa-miR-665 | ACCAGGAGGCUGAGGCCCCU | 873 | GCCTCCTGG | CCTCCTGG | CTCCTGG |
| hsa-miR-668 | UGUCACUCGGCUCGGCCCACUAC | 874 | CCGAGTGAC | CGAGTGAC | GAGTGAC |
| hsa-miR-671-3p | UCCGGUUCUCAGGGCUCCACC | 875 | GAGAACCGG | AGAACCGG | GAACCGG |
| hsa-miR-671-5p | AGGAAGCCCUGGAGGGGCUGGAG | 876 | AGGGCTTCC | GGGCTTCC | GGCTTCC |
| hsa-miR-675 | UGGUGCGGAGAGGGCCCACAGUG | 877 | CTCCGCACC | TCCGCACC | CCGCACC |
| hsa-miR-675b | CUGUAUGCCCUCACCGCUCA | 878 | GGGCATACA | GGCATACA | GCATACA |
| hsa-miR-7 | UGGAAGACUAGUGAUUUUGUUGU | 879 | TAGTCTTCC | AGTCTTCC | GTCTTCC |
| hsa-miR-7-1* | CAACAAAUCACAGUCUGCCAUA | 880 | TGATTTGTT | GATTTGTT | ATTTGTT |
| hsa-miR-7-2* | CAACAAAUCCCAGUCUACCUAA | 881 | GGATTTGTT | GATTTGTT | ATTTGTT |
| hsa-miR-708 | AAGGAGCUUACAAUCUAGCUGGG | 882 | TAAGCTCCT | AAGCTCCT | AGCTCCT |
| hsa-miR-708* | CAACUAGACUGUGAGCUUCUAG | 883 | AGTCTAGTT | GTCTAGTT | TCTAGTT |
| hsa-miR-720 | UCUCGCUGGGGCCUCCA | 884 | CCCAGCGAG | CCAGCGAG | CAGCGAG |
| hsa-miR-744 | UGCGGGGCUAGGGCUAACAGCA | 885 | TAGCCCCGC | AGCCCCGC | GCCCCGC |
| hsa-miR-744* | CUGUUGCCACUAACCUCAACCU | 886 | GTGGCAACA | TGGCAACA | GGCAACA |
| hsa-miR-758 | UUUGUGACCUGGUCCACUAACC | 887 | AGGTCACAA | GGTCACAA | GTCACAA |
| hsa-miR-760 | CGGCUCUGGGUCUGUGGGGA | 888 | CCCAGAGCC | CCAGAGCC | CAGAGCC |
| hsa-miR-765 | UGGAGGAGAAGGAAGGUGAUG | 889 | TTCTCCTCC | TCTCCTCC | CTCCTCC |
| hsa-miR-766 | ACUCCAGCCCCACAGCCUCAGC | 890 | GGGCTGGAG | GGCTGGAG | GCTGGAG |
| hsa-miR-767-3p | UCUGCUCAUACCCCAUGGUUUCU | 891 | TATGAGCAG | ATGAGCAG | TGAGCAG |
| hsa-miR-767-5p | UGCACCAUGGUUGUCUGAGCAUG | 892 | CCATGGTGC | CATGGTGC | ATGGTGC |
| hsa-miR-769-3p | CUGGGAUCUCCGGGGUCUUGGUU | 893 | GAGATCCCA | AGATCCCA | GATCCCA |
| hsa-miR-769-5p | UGAGACCUCUGGGUUCUGAGCU | 894 | AGAGGTCTC | GAGGTCTC | AGGTCTC |
| hsa-miR-770-5p | UCCAGUACCACGUGUCAGGGCCA | 895 | TGGTACTGG | GGTACTGG | GTACTGG |
| hsa-miR-802 | CAGUAACAAAGAUUCAUCCUUGU | 896 | TTTGTTACT | TTGTTACT | TGTTACT |

| microRNA | MicroRNASequence | SEQ ID NO | 9-mer Compound | 8-mer Compound | 7-mer Compound |
|---|---|---|---|---|---|
| hsa-miR-873 | GCAGGAACUUGUGAGUCUCCU | 897 | AAGTTCCTG | AGTTCCTG | GTTCCTG |
| hsa-miR-874 | CUGCCCUGGCCCGAGGGACCGA | 898 | GCCAGGGCA | CCAGGGCA | CAGGGCA |
| hsa-miR-875-3p | CCUGGAAACACUGAGGUUGUG | 899 | TGTTTCCAG | GTTTCCAG | TTTCCAG |
| hsa-miR-875-5p | UAUACCUCAGUUUUAUCAGGUG | 900 | CTGAGGTAT | TGAGGTAT | GAGGTAT |
| hsa-miR-876-3p | UGGUGGUUUACAAAGUAAUUCA | 901 | TAAACCACC | AAACCACC | AACCACC |
| hsa-miR-876-5p | UGGAUUUCUUUGUGAAUCACCA | 902 | AAGAAATCC | AGAAATCC | GAAATCC |
| hsa-miR-877 | GUAGAGGAGAUGGCGCAGGG | 903 | TCTCCTCTA | CTCCTCTA | TCCTCTA |
| hsa-miR-877* | UCCUCUUCUCCCUCCUCCCAG | 904 | GAGAAGAGG | AGAAGAGG | GAAGAGG |
| hsa-miR-885-3p | AGGCAGCGGGGUGUAGUGGAUA | 905 | CCCGCTGCC | CCGCTGCC | CGCTGCC |
| hsa-miR-885-5p | UCCAUUACACUACCCUGCCUCU | 906 | GTGTAATGG | TGTAATGG | GTAATGG |
| hsa-miR-886-3p | CGCGGGUGCUUACUGACCCUU | 907 | AGCACCCGC | GCACCCGC | CACCCGC |
| hsa-miR-886-5p | CGGGUCGGAGUUAGCUCAAGCGG | 908 | CTCCGACCC | TCCGACCC | CCGACCC |
| hsa-miR-887 | GUGAACGGGCGCCAUCCCGAGG | 909 | GCCCGTTCA | CCCGTTCA | CCGTTCA |
| hsa-miR-888 | UACUCAAAAAGCUGUCAGUCA | 910 | TTTTTGAGT | TTTTGAGT | TTTGAGT |
| hsa-miR-888* | GACUGACACCUCUUUGGGUGAA | 911 | GGTGTCAGT | GTGTCAGT | TGTCAGT |
| hsa-miR-889 | UUAAUAUCGGACAACCAUUGU | 912 | CCGATATTA | CGATATTA | GATATTA |
| hsa-miR-890 | UACUUGGAAAGGCAUCAGUUG | 913 | TTTCCAAGT | TTCCAAGT | TCCAAGT |
| hsa-miR-891a | UGCAACGAACCUGAGCCACUGA | 914 | GTTCGTTGC | TTCGTTGC | TCGTTGC |
| hsa-miR-891b | UGCAACUUACCUGAGUCAUUGA | 915 | GTAAGTTGC | TAAGTTGC | AAGTTGC |
| hsa-miR-892a | CACUGUGUCCUUUCUGCGUAG | 916 | GGACACAGT | GACACAGT | ACACAGT |
| hsa-miR-892b | CACUGGCUCCUUUCUGGGUAGA | 917 | GGAGCCAGT | GAGCCAGT | AGCCAGT |
| hsa-miR-9 | UCUUUGGUUAUCUAGCUGUAUGA | 918 | TAACCAAAG | AACCAAAG | ACCAAAG |
| hsa-miR-9* | AUAAAGCUAGAUAACCGAAAGU | 919 | CTAGCTTTA | TAGCTTTA | AGCTTTA |
| hsa-miR-920 | GGGGAGCUGUGGAAGCAGUA | 920 | ACAGCTCCC | CAGCTCCC | AGCTCCC |
| hsa-miR-921 | CUAGUGAGGGACAGAACCAGGAUUC | 921 | CCCTCACTA | CCTCACTA | CTCACTA |
| hsa-miR-922 | GCAGCAGAGAAUAGGACUACGUC | 922 | TCTCTGCTG | CTCTGCTG | TCTGCTG |
| hsa-miR-923 | GUCAGCGGAGGAAAAGAAACU | 923 | CTCCGCTGA | TCCGCTGA | CCGCTGA |
| hsa-miR-924 | AGAGUCUUGUGAUGUCUUGC | 924 | ACAAGACTC | CAAGACTC | AAGACTC |
| hsa-miR-92a | UAUUGCACUUGUCCCGGCCUGU | 925 | AAGTGCAAT | AGTGCAAT | GTGCAAT |
| hsa-miR-92a-1* | AGGUUGGGAUCGGUUGCAAUGCU | 926 | ATCCCAACC | TCCCAACC | CCCAACC |
| hsa-miR-92a-2* | GGGUGGGGAUUUGUUGCAUUAC | 927 | ATCCCCACC | TCCCCACC | CCCCACC |
| hsa-miR-92b | UAUUGCACUCGUCCCGGCCUCC | 928 | GAGTGCAAT | AGTGCAAT | GTGCAAT |
| hsa-miR-92b* | AGGGACGGGACGCGGUGCAGUG | 929 | TCCCGTCCC | CCCGTCCC | CCGTCCC |
| hsa-miR-93 | CAAAGUGCUGUUCGUGCAGGUAG | 930 | CAGCACTTT | AGCACTTT | GCACTTT |
| hsa-miR-93* | ACUGCUGAGCUAGCACUUCCCG | 931 | GCTCAGCAG | CTCAGCAG | TCAGCAG |
| hsa-miR-933 | UGUGCGCAGGGAGACCUCUCCC | 932 | CCTGCGCAC | CTGCGCAC | TGCGCAC |
| hsa-miR-934 | UGUCUACUACUGGAGACACUGG | 933 | GTAGTAGAC | TAGTAGAC | AGTAGAC |
| hsa-miR-935 | CCAGUUACCGCUUCCGCUACCGC | 934 | CGGTAACTG | GGTAACTG | GTAACTG |

-continued

| microRNA | MicroRNASequence | SEQ ID NO | 9-mer Compound | 8-mer Compound | 7-mer Compound |
|---|---|---|---|---|---|
| hsa-miR-936 | ACAGUAGAGGGAGGAAUCGCAG | 935 | CCTCTACTG | CTCTACTG | TCTACTG |
| hsa-miR-937 | AUCCGCGCUCUGACUCUCUGCC | 936 | GAGCGCGGA | AGCGCGGA | GCGCGGA |
| hsa-miR-938 | UGCCCUUAAAGGUGAACCCAGU | 937 | TTTAAGGGC | TTAAGGGC | TAAGGGC |
| hsa-miR-939 | UGGGGAGCUGAGGCUCUGGGGGUG | 938 | CAGCTCCCC | AGCTCCCC | GCTCCCC |
| hsa-miR-940 | AAGGCAGGGCCCCCGCUCCCC | 939 | GCCCTGCCT | CCCTGCCT | CCTGCCT |
| hsa-miR-941 | CACCCGGCUGUGUGCACAUGUGC | 940 | CAGCCGGGT | AGCCGGGT | GCCGGGT |
| hsa-miR-942 | UCUUCUCUGUUUUGGCCAUGUG | 941 | ACAGAGAAG | CAGAGAAG | AGAGAAG |
| hsa-miR-943 | CUGACUGUUGCCGUCCUCCAG | 942 | CAACAGTCA | AACAGTCA | ACAGTCA |
| hsa-miR-944 | AAAUUAUUGUACAUCGGAUGAG | 943 | ACAATAATT | CAATAATT | AATAATT |
| hsa-miR-95 | UUCAACGGGUAUUUAUUGAGCA | 944 | ACCCGTTGA | CCCGTTGA | CCGTTGA |
| hsa-miR-96 | UUUGGCACUAGCACAUUUUUGCU | 945 | TAGTGCCAA | AGTGCCAA | GTGCCAA |
| hsa-miR-96* | AAUCAUGUGCAGUGCCAAUAUG | 946 | GCACATGAT | CACATGAT | ACATGAT |
| hsa-miR-98 | UGAGGUAGUAAGUUGUAUUGUU | 947 | TACTACCTC | ACTACCTC | CTACCTC |
| hsa-miR-99a | AACCCGUAGAUCCGAUCUUGUG | 948 | TCTACGGGT | CTACGGGT | TACGGGT |
| hsa-miR-99a* | CAAGCUCGCUUCUAUGGGUCUG | 949 | AGCGAGCTT | GCGAGCTT | CGAGCTT |
| hsa-miR-99b | CACCCGUAGAACCGACCUUGCG | 950 | TCTACGGGT | CTACGGGT | TACGGGT |
| hsa-miR-99b* | CAAGCUCGUGUCUGUGGGUCCG | 951 | CACGAGCTT | ACGAGCTT | CGAGCTT |
| hsv1-miR-H1 | UGGAAGGACGGGAAGUGGAAG | 952 | CGTCCTTCC | GTCCTTCC | TCCTTCC |
| hsv1-miR-H2-3p | CCUGAGCCAGGGACGAGUGCGACU | 953 | CTGGCTCAG | TGGCTCAG | GGCTCAG |
| hsv1-miR-H2-5p | UCGCACGCGCCCGGCACAGACU | 954 | GCGCGTGCG | CGCGTGCG | GCGTGCG |
| hsv1-miR-H3 | CUGGGACUGUGCGGUUGGGA | 955 | ACAGTCCCA | CAGTCCCA | AGTCCCA |
| hsv1-miR-H4-3p | CUUGCCUGUCUAACUCGCUAGU | 956 | GACAGGCAA | ACAGGCAA | CAGGCAA |
| hsv1-miR-H4-5p | GGUAGAGUUUGACAGGCAAGCA | 957 | AAACTCTAC | AACTCTAC | ACTCTAC |
| hsv1-miR-H5 | GUCAGAGAUCCAAACCCUCCGG | 958 | GATCTCTGA | ATCTCTGA | TCTCTGA |
| hsv1-miR-H6 | CACUUCCCGUCCUUCCAUCCC | 959 | ACGGGAAGT | CGGGAAGT | GGGAAGT |
| kshv-miR-K12-1 | AUUACAGGAAACUGGGUGUAAGC | 960 | TTCCTGTAA | TCCTGTAA | CCTGTAA |
| kshv-miR-K12-10a | UAGUGUUGUCCCCCCGAGUGGC | 961 | GACAACACT | ACAACACT | CAACACT |
| kshv-miR-K12-10b | UGGUGUUGUCCCCCCGAGUGGC | 962 | GACAACACC | ACAACACC | CAACACC |
| kshv-miR-K12-11 | UUAAUGCUUAGCCUGUGUCCGA | 963 | TAAGCATTA | AAGCATTA | AGCATTA |
| kshv-miR-K12-12 | ACCAGGCCACCAUUCCUCUCCG | 964 | GTGGCCTGG | TGGCCTGG | GGCCTGG |
| kshv-miR-K12-2 | AACUGUAGUCCGGGUCGAUCUG | 965 | GACTACAGT | ACTACAGT | CTACAGT |
| kshv-miR-K12-3 | UCACAUUCUGAGGACGGCAGCGA | 966 | CAGAATGTG | AGAATGTG | GAATGTG |
| kshv-miR-K12-3* | UCGCGGUCACAGAAUGUGACA | 967 | GTGACCGCG | TGACCGCG | GACCGCG |
| kshv-miR-K12-4-3p | UAGAAUACUGAGGCCUAGCUGA | 968 | CAGTATTCT | AGTATTCT | GTATTCT |
| kshv-miR-K12-4-5p | AGCUAAACCGCAGUACUCUAGG | 969 | CGGTTTAGC | GGTTTAGC | GTTTAGC |
| kshv-miR-K12-5 | UAGGAUGCCUGGAACUUGCCGG | 970 | AGGCATCCT | GGCATCCT | GCATCCT |
| kshv-miR-K12-6-3p | UGAUGGUUUUCGGGCUGUUGAG | 971 | AAAACCATC | AAACCATC | AACCATC |
| kshv-miR-K12-6-5p | CCAGCAGCACCUAAUCCAUCGG | 972 | GTGCTGCTG | TGCTGCTG | GCTGCTG |

| microRNA | MicroRNASequence | SEQ ID NO | 9-mer Compound | 8-mer Compound | 7-mer Compound |
|---|---|---|---|---|---|
| kshv-miR-K12-7 | UGAUCCCAUGUUGCUGGCGCU | 973 | CATGGGATC | ATGGGATC | TGGGATC |
| kshv-miR-K12-8 | UAGGCGCGACUGAGAGAGCACG | 974 | GTCGCGCCT | TCGCGCCT | CGCGCCT |
| kshv-miR-K12-9 | CUGGGUAUACGCAGCUGCGUAA | 975 | GTATACCCA | TATACCCA | ATACCCA |
| kshv-miR-K12-9* | ACCCAGCUGCGUAAACCCCGCU | 976 | GCAGCTGGG | CAGCTGGG | AGCTGGG |

SEQUENCE LISTING (984 sequences)

SEQ ID NO: 1 - DNA, 15 bp, artificial
  Seedmer, optionally fully LNA phosphorothioate
  misc_feature (1)..(15): Phosphorothioate linkages, LNAs at positions 1, 3, 4, 6, 7, 8, 10, 12, 14 & 15 otherwise DNAnts.
tcagtctgataagct

SEQ ID NO: 2 - DNA, 8 bp, artificial
  LNA Oligomer
  misc_feature (1)..(8): Fully LNA & Phosphorothioate linkages
gataagct

SEQ ID NO: 3 - DNA, 15 bp, artificial
  LNA Oligomer
  misc_feature (1)..(15): Phosphorothioate linkages, LNAs at positions 1, 3, 5, 6, 7, 10, 11, 12, 14 & 15 otherwise DNAnts.
tcacaattagcatta

SEQ ID NO: 4 - DNA, 8 bp, artificial
  LNA Oligomer
  misc_feature (1)..(8): Fully LNA & Phosphorothioate linkages
tagcatta

SEQ ID NO: 5 - DNA, 15 bp, artificial
  LNA Oligomer
  misc_feature (1)..(15): Phosphorothioate linkages, LNAs at positions 1, 3, 6, 7, 8, 10, 12, 14 & 15 otherwise DNAnts.
ccattgtcacactcc

SEQ ID NO: 6 - DNA, 8 bp, artificial
  LNA Oligomer
  misc_feature (1)..(8): Fully LNA & Phosphorothioate linkages
cacactcc

SEQ ID NO: 7 - DNA, 6 bp, artificial
  LNA Oligomer
  misc_feature (1)..(6): Fully LNA & Phosphorothioate linkages
taagct

SEQ ID NO: 8 - DNA, 7 bp, artificial
  LNA Oligomer
  misc_feature (1)..(7): Fully LNA & Phosphorothioate linkages
ataagct

SEQ ID NO: 9 - DNA, 9 bp, artificial
  LNA Oligomer
  misc_feature (1)..(9): Fully LNA & Phosphorothioate linkages
tgataagct

SEQ ID NO: 10 - DNA, 10 bp, artificial
  LNA Oligomer
  misc_feature (1)..(10): Fully LNA & Phosphorothioate linkages
ctgataagct

SEQ ID NO: 11 - DNA, 12 bp, artificial
  LNA Oligomer
  misc_feature (1)..(12): Fully LNA & Phosphorothioate linkages
gtctgataagct

SEQ ID NO: 12 - DNA, 14 bp, artificial
  LNA Oligomer
  misc_feature (1)..(14): Fully LNA & Phosphorothioate linkages
cagtctgataagct

SEQ ID NO: 13 - DNA, 8 bp, artificial
  LNA Oligomer
  misc_feature (1)..(8): Fully LNA & Phosphorothioate linkages
tctgataa

SEQ ID NO: 14 - DNA, 8 bp, artificial
  LNA Oligomer
  misc_feature (1)..(8): Fully LNA & Phosphorothioate linkages
atcagtct

SEQ ID NO: 15 - DNA, 8 bp, artificial
  LNA Oligomer
  misc_feature (1)..(8): Fully LNA & Phosphorothioate linkages
tcaacatc

SEQ ID NO: 16 - DNA, 8 bp, artificial
  LNA Oligomer
  misc_feature (1)..(8): Fully LNA & Phosphorothioate linkages
ggtaaact

SEQ ID NO: 17 - DNA, 8 bp, artificial
  LNA Oligomer
  misc_feature (1)..(8): Fully LNA & Phosphorothioate linkages
cgtaatga

SEQ ID NO: 18 - DNA, 16 bp, artificial
  LNA Oligomer
  misc_feature (1)..(16): LNA gapmer 3LNA- 9DNA-3LNA-1DNA, 5' FAM label, phosphorothioate linkages.
tcagtctgataagcta

SEQ ID NO: 19 - DNA, 8 bp, artificial
  LNA Oligomer
  misc_feature (1)..(8): Full LNA & Phosphorothioate linkages
agcacttt

SEQ ID NO: 20 - DNA, 8 bp, artificial
  LNA Oligomer
  misc_feature (1)..(8): Full LNA & Phosphorothioate linkages
atttgcac

SEQ ID NO: 21 - DNA, 15 bp, artificial
  LNA Oligomer
agcagacaatgtagc

SEQ ID NO: 22 - DNA, 15 bp, artificial
  LNA Oligomer
gtagccagatgtagc

SEQ ID NO: 23 - DNA, 7 bp, artificial
  LNA Oligomer
  misc_feature (1)..(7): Full LNA & Phosphorothioate linkages
atgtagc

SEQ ID NO: 24 - DNA, 15 bp, artificial
  LNA Oligomer
acaacctactacctc

SEQ ID NO: 25 - DNA, 8 bp, artificial
  LNA Oligomer
  misc_feature (1)..(8): Full LNA & Phosphorothioate linkages
actacctc

SEQ ID NO: 26 - DNA, 15 bp, artificial
  LNA Oligomer
cactgtcagcacttt

SEQ ID NO: 27 - DNA, 15 bp, artificial
  LNA Oligomer
tgcatagatttgcac

SEQ ID NO: 28 - DNA, 7 bp, artificial
  LNA Oligomer
  misc_feature (1)..(7): Full LNA & Phosphorothioate linkages
gtagact

SEQ ID NO: 29 - DNA, 6 bp, artificial
  LNA Oligomer
  misc_feature (1)..(6): Full LNA & Phosphorothioate linkages
tacctc

SEQ ID NO: 30 - DNA, 7 bp, artificial
  LNA Oligomer
  misc_feature (1)..(7): Full LNA & Phosphorothioate linkages
ctacctc

SEQ ID NO: 31 - DNA, 9 bp, artificial
  LNA Oligomer
  misc_feature (1)..(9): Full LNA & Phosphorothioate linkages, n = Universal base
tnctacctc

SEQ ID NO: 32 - DNA, 9 bp, artificial
  LNA Oligomer
  misc_feature (1)..(9): Full LNA & Phosphorothioate linkages, n = Universal base
tnctacctc

SEQ ID NO: 33 - DNA, 15 bp, artificial
  LNA Oligomer
gcaacctactacctc

SEQ ID NO: 34 - DNA, 15 bp, artificial
  LNA Oligomer
acaacctcctacctc

SEQ ID NO: 35 - DNA, 15 bp, artificial
  LNA Oligomer
acaaactactacctc

SEQ ID NO: 36 - DNA, 7 bp, artificial
  LNA Oligomer
  misc_feature (1)..(7): Full LNA & Phosphorothioate linkages,
ctacctc

SEQ ID NO: 37 - DNA, 7 bp, artificial
  LNA Oligomer
  misc_feature (1)..(7): Full LNA & Phosphorothioate linkages,
ctaactc

SEQ ID NO: 38 - DNA, 9 bp, artificial
  LNA Oligomer
  misc_feature (1)..(9): Full LNA & Phosphorothioate linkages,
ttagcatta

SEQ ID NO: 39 - DNA, 9 bp, artificial
  LNA Oligomer
  misc_feature (1)..(9): Full LNA & Phosphorothioate linkages,
ttagcatta

SEQ ID NO: 40 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagcaccgcuauccacuauguc

SEQ ID NO: 41 - RNA, 24 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucuuaguggaagugacgugcugug

SEQ ID NO: 42 - RNA, 23 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacauaaccauggaguuggcugu

SEQ ID NO: 43 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gccaccucuuugguucuguaca

SEQ ID NO: 44 - RNA, 21 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acgcacaccaggcugacugcc

SEQ ID NO: 45 - RNA, 24 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucagacaguuuggugcgcuaguug

SEQ ID NO: 46 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uccugugguguuuggugugguu

SEQ ID NO: 47 - RNA, 23 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uguaacuugccagggacggcuga

SEQ ID NO: 48 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaccggcucguggcucguacag

SEQ ID NO: 49 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaaaugcugcaguaguagggau

SEQ ID NO: 50 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacccuacgcugccgauuuaca

SEQ ID NO: 51 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gucagugguuuuguuuccuuga

SEQ ID NO: 52 - RNA, 24 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuagauagagugggugugugcucu

SEQ ID NO: 53 - RNA, 23 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uguaugccugguguccccuuagu

SEQ ID NO: 54 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaagaggacgcaggcauacaag

SEQ ID NO: 55 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaucggaaguuugggcuucguc

SEQ ID NO: 56 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucaaguucgcacuuccuauaca

SEQ ID NO: 57 - RNA, 21 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuuuguuugcuugggaaugcu

SEQ ID NO: 58 - RNA, 23 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acauuccccgcaaacaugacaug

SEQ ID NO: 59 - RNA, 24 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaggagcgauuuggagaaaauaaa

SEQ ID NO: 60 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uauuuucugcauucgcccuugc

SEQ ID NO: 61 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caugaaggcacagccuguuacc

SEQ ID NO: 62 - RNA, 21 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagcaggcaugucuucauucc

SEQ ID NO: 63 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cgcaccacuagucaccaggugu

SEQ ID NO: 64 - RNA, 21 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
accuaguguuaguguugugcu

SEQ ID NO: 65 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaccugaugcugcuggugugcu

SEQ ID NO: 66 - RNA, 24 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaggugaauauagcugcccaucg

SEQ ID NO: 67 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cggggaucggacuagccuuaga

SEQ ID NO: 68 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaagguugguccaauccauagg

SEQ ID NO: 69 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caucauaguccaguguccaggg

SEQ ID NO: 70 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccuggaccuugacuaugaaaca

SEQ ID NO: 71 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacgguuuccuagauuguacag

SEQ ID NO: 72 - RNA, 23 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gucacaaucuauggggucguaga

SEQ ID NO: 73 - RNA, 23 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaacacuucaugggucccguagu

SEQ ID NO: 74 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacuggacccugaauuggaaac

SEQ ID NO: 75 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaaccugaucagccccggaguu

SEQ ID NO: 76 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaucuuuugcggcagaaauuga

SEQ ID NO: 77 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaauucuguugcagcagauagc

SEQ ID NO: 78 - RNA, 22 nt, Epstein Barr virus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaacgggaaguguguaagcaca

SEQ ID NO: 79 - RNA, 22 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aagugacggugagauccaggcu

SEQ ID NO: 80 - RNA, 21 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucguccuccccuucuucaccg

SEQ ID NO: 81 - RNA, 20 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaacuagccuucccgugaga

SEQ ID NO: 82 - RNA, 22 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucaccagaaugcuaguuuguag

SEQ ID NO: 83 - RNA, 22 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucguugaagacaccuggaaaga

SEQ ID NO: 84 - RNA, 22 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuuccagguguuuucaacgugc

SEQ ID NO: 85 - RNA, 20 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ggggaugggcuggcgcgcgg

SEQ ID NO: 86 - RNA, 21 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugcgucucggccucguccaga

SEQ ID NO: 87 - RNA, 21 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaccgcucaguggcucggacc

SEQ ID NO: 88 - RNA, 22 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uccgaacgcuaggucgguucuc

SEQ ID NO: 89 - RNA, 23 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auccacuuggagagcucccgcgg

SEQ ID NO: 90 - RNA, 22 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agcggucuguucagguggauga

SEQ ID NO: 91 - RNA, 20 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucacgguccgagcacaucca

SEQ ID NO: 92 - RNA, 22 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gauugugcccggaccgugggcg

SEQ ID NO: 93 - RNA, 22 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cgacauggacgugcagggggau

SEQ ID NO: 94 - RNA, 21 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugacaagccugacgagagcgu

SEQ ID NO: 95 - RNA, 22 nt, Human cytomegalovirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuaugauaggugugacgauguc

SEQ ID NO: 96 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagguaguagguuguauaguu

SEQ ID NO: 97 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuauacaaucuacugucuuuc

SEQ ID NO: 98 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagguaguagguugugugguu

SEQ ID NO: 99 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuauacaaccuacugccuuccc

SEQ ID NO: 100 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagguaguagguuguaugguu

SEQ ID NO: 101 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagaguuacacccugggaguua

SEQ ID NO: 102 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agagguaguagguugcauaguu

SEQ ID NO: 103 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuauacgaccugcugccuuucu

SEQ ID NO: 104 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagguaggagguuguauaguu

SEQ ID NO: 105 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuauacggccuccuagcuuucc

SEQ ID NO: 106 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagguaguagauuguauaguu

SEQ ID NO: 107 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuauacaaucuauugccuuccc

SEQ ID NO: 108 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuauacagucuacugucuuucc

SEQ ID NO: 109 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagguaguaguuuguacaguu

SEQ ID NO: 110 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuguacaggccacugccuugc

SEQ ID NO: 111 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagguaguaguuugugcuguu

SEQ ID NO: 112 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugcgcaagcuacugccuugcu

SEQ ID NO: 113 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggaauguaaagaaguauguau

SEQ ID NO: 114 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacccguagauccgaacuugug

SEQ ID NO: 115 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caagcuuguaucuauagguaug

SEQ ID NO: 116 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacaguacugugauaacugaa

SEQ ID NO: 117 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caguuaucacagugcugaugcu

SEQ ID NO: 118 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agcagcauuguacagggcuauga

SEQ ID NO: 119 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucauagcccuguacaaugcugcu

SEQ ID NO: 120 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucaaaugcucagacuccuguggu

SEQ ID NO: 121 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acggauguuugagcaugugcua

SEQ ID NO: 122 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaagugcuuacagugcagguag

SEQ ID NO: 123 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugcaauguaagcacuucuuac

SEQ ID NO: 124 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaaagugcugacagugcagau

SEQ ID NO: 125 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccgcacuguggguacuugcugc

SEQ ID NO: 126 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agcagcauuguacagggcuauca

SEQ ID NO: 127 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacccuguagauccgaauuugug

SEQ ID NO: 128 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaauucguaucuaggggaaua

SEQ ID NO: 129 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacccuguagaaccgaauuugug

SEQ ID NO: 130 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acagauucgauucuaggggaau

SEQ ID NO: 131 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uugcucacuguucuucccuag

SEQ ID NO: 132 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aagcauucuuucauugguugg

SEQ ID NO: 133 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuuccggcucgcgugggugugu

SEQ ID NO: 134 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccgucgccgccacccgagccg

SEQ ID NO: 135 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gagggucuugggagggaugugac

SEQ ID NO: 136 - RNA, 27 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cacuguaggugauggugagagugggca

SEQ ID NO: 137 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccugcagcgacuugauggcuucc

SEQ ID NO: 138 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agaggauacccuuuguauguu

SEQ ID NO: 139 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaggacacauggucuacuucu

SEQ ID NO: 140 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuccugagccauucugagccuc

SEQ ID NO: 141 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agccugauuaaacacaugcucuga

SEQ ID NO: 142 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugccagcugcagugggggag

SEQ ID NO: 143 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cccggagccaggaugcagcuc

SEQ ID NO: 144 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucguggccuggucuccauuau

SEQ ID NO: 145 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucugcaggguuugcuuugag

SEQ ID NO: 146 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uguucauguagauguuuaagc

SEQ ID NO: 147 - RNA, 18 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucagcuggcccucauuuc

SEQ ID NO: 148 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggcagggaggcugggagggg

SEQ ID NO: 149 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucacuguucagacaggcgga

SEQ ID NO: 150 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggagugugacaaugguguuug

SEQ ID NO: 151 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacgccauuaucacacuaaaua

SEQ ID NO: 152 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccccaccuccucucuccucag

SEQ ID NO: 153 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugaggacucgggaggugg

SEQ ID NO: 154 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagccccugugccgcccccag

SEQ ID NO: 155 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
guggguacggcccagugggggg

SEQ ID NO: 156 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucaccagcccuguguucccuag

SEQ ID NO: 157 - RNA, 26 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugagggcaugcaggccuggaugggg

SEQ ID NO: 158 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cgugccacccuuuuccccag

SEQ ID NO: 159 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucacaccugccucgcccccc

SEQ ID NO: 160 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugggcgggggcaggugugug

SEQ ID NO: 161 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cucucaccacugcccucccacag

SEQ ID NO: 162 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugucugggcggacagcugc

SEQ ID NO: 163 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagcccuguccucccgcag

SEQ ID NO: 164 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucggccugaccacccaccccac

SEQ ID NO: 165 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccucuuccccuugucucuccag

SEQ ID NO: 166 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uccuucugcuccgucccccag

SEQ ID NO: 167 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuuccucgucugucugcccc

SEQ ID NO: 168 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaaggcacgcggugaaugcc

SEQ ID NO: 169 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cguguucacagcggaccuugau

SEQ ID NO: 170 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacuggaucaauuauaggagug

SEQ ID NO: 171 - RNA, 26 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaguaguugguuuguaugagaugguu

SEQ ID NO: 172 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aagugaucuaaaggccuacau

SEQ ID NO: 173 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aauggauuuuuggagcagg

SEQ ID NO: 174 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acccgucccguucguccccgga

SEQ ID NO: 175 - RNA, 27 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
accuucuuguauaagcacugugcuaaa

SEQ ID NO: 176 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acgcccuucccccccuucuuca

SEQ ID NO: 177 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acggugcuggauguggccuuu

SEQ ID NO: 178 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acucuagcugccaaaggcgcu

SEQ ID NO: 179 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agaaggaaauugaauucauuua

SEQ ID NO: 180 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agagaagaagaucagccugca

SEQ ID NO: 181 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agccuggaagcuggagccugcagu

SEQ ID NO: 182 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggaugagcaaagaaaguagauu

SEQ ID NO: 183 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cggaugagcaaagaaagugguu

SEQ ID NO: 184 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggcauugacuucucacuagcu

SEQ ID NO: 185 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agugaaugauggguucugacc

SEQ ID NO: 186 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aguuaggauuaggucguggaa

SEQ ID NO: 187 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auauaugaugacuuagcuuuu

SEQ ID NO: 188 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acaggugagguucuugggagcc

SEQ ID NO: 189 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucccugagacccuuuaaccuguga

SEQ ID NO: 190 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucccugagacccuaacuuguga

SEQ ID NO: 191 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acggguuaggcucuugggagcu

SEQ ID NO: 192 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucacaagucaggcucuugggac

SEQ ID NO: 193 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucguaccgugaguaauaaugcg

SEQ ID NO: 194 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cauuauuacuuuugguacgcg

SEQ ID NO: 195 - RNA, 18 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aucccaccucugccacca

SEQ ID NO: 196 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auggauaaggcuuuggcuu

SEQ ID NO: 197 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
augggugaauuuguagaaggau

SEQ ID NO: 198 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
augguacccuggcauacugagu

SEQ ID NO: 199 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caagucuuauuugagcaccuguu

SEQ ID NO: 200 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caggauguggucaaguguuguu

SEQ ID NO: 201 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccucagggcuguagaacagggcu

SEQ ID NO: 202 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccuguugaaguguaaucccca

SEQ ID NO: 203 - RNA, 18 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cgggcguggugguggggg

SEQ ID NO: 204 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuggacugagccgugcuacugg

SEQ ID NO: 205 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucggauccgucugagcuuggcu

SEQ ID NO: 206 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugaagcucagagggcucugau

SEQ ID NO: 207 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuggagauauggaagagcugugu

SEQ ID NO: 208 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuuggcaccuagcaagcacuca

SEQ ID NO: 209 - RNA, 26 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaugaugauggcagcaaauucugaaa

SEQ ID NO: 210 - RNA, 25 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gggcgacaaagcaagacucuuucuu

SEQ ID NO: 211 - RNA, 18 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gucccuguucaggcgcca

SEQ ID NO: 212 - RNA, 17 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucccuguucgggcgcca

SEQ ID NO: 213 - RNA, 17 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugggggagaggcuguc

SEQ ID NO: 214 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaaagagcccuguggagaca

SEQ ID NO: 215 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacguagauauauauguauuuu

SEQ ID NO: 216 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaguacugugcauaucaucuau

SEQ ID NO: 217 - RNA, 17 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucauauugcuucuuucu

SEQ ID NO: 218 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucacagugaaccggucucuuu

SEQ ID NO: 219 - RNA, 17 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucccaccgcugccaccc

SEQ ID NO: 220 - RNA, 17 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucgccuccuccucuccc

SEQ ID NO: 221 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucguuugccuuuuucugcuu

SEQ ID NO: 222 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucuacaaaggaaagcgcuuucu

SEQ ID NO: 223 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucuauacagacccuggcuuuuc

SEQ ID NO: 224 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucugggcaacaaagugagaccu

SEQ ID NO: 225 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugcaggaccaagaugagcccu

SEQ ID NO: 226 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugcuggaucagugguucgaguc

SEQ ID NO: 227 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggacugcccugaucuggaga

SEQ ID NO: 228 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggaguccaggaaucugcauuuu

SEQ ID NO: 229 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aagcccuuaccccaaaaaguau

SEQ ID NO: 230 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aagcccuuaccccaaaaagcau

SEQ ID NO: 231 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuuuuugcggucugggcuugc

SEQ ID NO: 232 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggauuuuuggaucaggga

SEQ ID NO: 233 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggcccugacugaagaccagcagu

SEQ ID NO: 234 - RNA, 25 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugggaacggguuccggcagacgcug

SEQ ID NO: 235 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggguggucuggagauuugugc

SEQ ID NO: 236 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugugagguuggcauuguugucu

SEQ ID NO: 237 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuaggccgcagaucuggguga

SEQ ID NO: 238 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuagggcccuggcuccaucucc

SEQ ID NO: 239 - RNA, 17 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucaaguaauucaggug

SEQ ID NO: 240 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucauucggcuguccagaugua

SEQ ID NO: 241 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucuggaauucugugugaggga

SEQ ID NO: 242 - RNA, 18 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uugagaaggaggcugcug

SEQ ID NO: 243 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uugcagcugccugggagugacuuc

SEQ ID NO: 244 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uugggacauacuuaugcuaaa

SEQ ID NO: 245 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuuagagacggggucuugcucu

SEQ ID NO: 246 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuugaggcuacagugagaugug

SEQ ID NO: 247 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuuucaacucuaaugggagaga

SEQ ID NO: 248 - RNA, 18 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acguuggcucugguggug

SEQ ID NO: 249 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acucggcguggcgucggucgug

SEQ ID NO: 250 - RNA, 18 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcaugggugguucagugg

SEQ ID NO: 251 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cagugcaauguuaaaagggcau

SEQ ID NO: 252 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucacauugugcuacugucugc

SEQ ID NO: 253 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cagugcaaugaugaaagggcau

SEQ ID NO: 254 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acucuuucccuguugcacuac

SEQ ID NO: 255 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaacagucuacagccauggucg

SEQ ID NO: 256 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
accguggcuuucgauuguuacu

SEQ ID NO: 257 - RNA, 18 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cagggaggugaaugugau

SEQ ID NO: 258 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaugaugcugcugaugcug

SEQ ID NO: 259 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucaaaacugaggggcauuuucu

SEQ ID NO: 260 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccagacagaauucuaugcacuuuc

SEQ ID NO: 261 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuugguccccuucaaccagcug

SEQ ID NO: 262 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuugguccccuucaaccagcua

SEQ ID NO: 263 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugugacugguugaccagagggg

SEQ ID NO: 264 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uauggcuuuuuauuccuauguga

SEQ ID NO: 265 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uauagggauuggagccguggcg

SEQ ID NO: 266 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uauggcuuuucauuccuauguga

SEQ ID NO: 267 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auguagggcuaaaagccauggg

SEQ ID NO: 268 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acuccauuuguuuugaugaugga

SEQ ID NO: 269 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caucaucgucucaaaugagucu

SEQ ID NO: 270 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuauugcuuaagaauacgcguag

SEQ ID NO: 271 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agcugguguugugaaucaggccg

SEQ ID NO: 272 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcuacuucacaacaccagggcc

SEQ ID NO: 273 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcuauuucacgacaccaggguu

SEQ ID NO: 274 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ggagacgcggcccuguuggagu

SEQ ID NO: 275 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucuacagugcacgugucuccag

SEQ ID NO: 276 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaccacaggguagaaccacgg

SEQ ID NO: 277 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cagugguuuuacccuaugguag

SEQ ID NO: 278 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaacacugucugguaaagaugg

SEQ ID NO: 279 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caucuuccaguacaguguugga

SEQ ID NO: 280 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uguaguguuuccuacuuuaugga

SEQ ID NO: 281 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cauaaaguagaaagcacuacu

SEQ ID NO: 282 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagaugaagcacuguagcuc

SEQ ID NO: 283 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ggugcagugcugcaucucuggu

SEQ ID NO: 284 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacaguauagaugauguacu

SEQ ID NO: 285 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ggauaucaucauauacuguaag

SEQ ID NO: 286 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
guccaguuuucccaggaaucccu

SEQ ID NO: 287 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ggauuccuggaaauacuguucu

SEQ ID NO: 288 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuccguuugccuguuucgcug

SEQ ID NO: 289 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cucggcgcggggcgcgggcucc

SEQ ID NO: 290 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagaacugaauuccauggguu

SEQ ID NO: 291 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccucugaaauucaguucuucag

SEQ ID NO: 292 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugcccuguggacucaguucugg

SEQ ID NO: 293 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagaacugaauuccauaggcu

SEQ ID NO: 294 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
guguguggaaaugcuucugc

SEQ ID NO: 295 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcccuccgcccgugcaccccg

SEQ ID NO: 296 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcccgcguguggagccaggugu

SEQ ID NO: 297 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugugcggaaaugcuucugcua

SEQ ID NO: 298 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucagugcacuacagaacuuugu

SEQ ID NO: 299 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaguucugagacacuccgacu

SEQ ID NO: 300 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucagugcaucacagaacuuugu

SEQ ID NO: 301 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaguucuguuauacacucaggc

SEQ ID NO: 302 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucuggcuccgugucuucacuccc

SEQ ID NO: 303 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agggagggacgggggcugugc

SEQ ID NO: 304 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucucccaacccuuguaccagug

SEQ ID NO: 305 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugguacaggccugggggacag

SEQ ID NO: 306 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuagacugaagcuccuugagg

SEQ ID NO: 307 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucgaggagcucacagucuagu

SEQ ID NO: 308 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucagugcaugacagaacuugg

SEQ ID NO: 309 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uugcauagucacaaaagugauc

SEQ ID NO: 310 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaaccgucuaguuacaguugu

SEQ ID NO: 311 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cggcccgggcugcugcuguuccu

SEQ ID NO: 312 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uccugcgcgucccagaugccc

SEQ ID NO: 313 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagguuauccguguugccuucg

SEQ ID NO: 314 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaucauacacgguugaccuauu

SEQ ID NO: 315 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuaaugcuaaucgugauaggggu

SEQ ID NO: 316 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuccuacauauuagcauuaaca

SEQ ID NO: 317 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagcagcacauaaugguuugug

SEQ ID NO: 318 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caggccauauugugcugccuca

SEQ ID NO: 319 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagcagcacaucaugguuuaca

SEQ ID NO: 320 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cgaaucauuauuugcugcucua

SEQ ID NO: 321 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagcagcacguaaauauuggcg

SEQ ID NO: 322 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccaguauuaacugugcugcuga

SEQ ID NO: 323 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccaauauuacugugcugcuuua

SEQ ID NO: 324 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaagugcuuacagugcagguag

SEQ ID NO: 325 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acugcagugaaggcacuuguag

SEQ ID NO: 326 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacauucaacgcugucggugagu

SEQ ID NO: 327 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
accaucgaccguugauuguacc

SEQ ID NO: 328 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
accacugaccguugacuguacc

SEQ ID NO: 329 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacauucauugcugucggugggu

SEQ ID NO: 330 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacauucaaccugucggugagu

SEQ ID NO: 331 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaccaucgaccguugaguggac

SEQ ID NO: 332 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacauucauuguugucggugggu

SEQ ID NO: 333 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuuggcaaugguagaacucacacu

SEQ ID NO: 334 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugguucuagacuugccaacua

SEQ ID NO: 335 - RNA, 18 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uccagugcccuccucucc

SEQ ID NO: 336 - RNA, 27 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auugaucaucgacacuucgaacgcaau

SEQ ID NO: 337 - RNA, 18 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugaggcaguagauugaau

SEQ ID NO: 338 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uauggcacugguagaauucacu

SEQ ID NO: 339 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugaauuaccgaagggccauaa

SEQ ID NO: 340 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggacggagaacugauaagggu

SEQ ID NO: 341 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggagagaaaggcaguuccuga

SEQ ID NO: 342 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggggcuggcuuuccucugguc

SEQ ID NO: 343 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaagaauucuccuuuugggcu

SEQ ID NO: 344 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcccaaaggugaauuuuuuggg

SEQ ID NO: 345 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucgugucuuguguugcagccgg

SEQ ID NO: 346 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ggcuacaacacaggacccgggc

SEQ ID NO: 347 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cucccacaugcaggguuugca

SEQ ID NO: 348 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caucccuugcaugguggaggg

SEQ ID NO: 349 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaaggugcaucuagugcagauag

SEQ ID NO: 350 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acugcccuaagugcuccuucugg

SEQ ID NO: 351 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaaggugcaucuagugcaguuag

SEQ ID NO: 352 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugcccuaaaugccccuucuggc

SEQ ID NO: 353 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugauauguuugauauauuaggu

SEQ ID NO: 354 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cggcggggacggcgauugguc

SEQ ID NO: 355 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cgcaggggccgggugcucaccg

SEQ ID NO: 356 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagugccggugccugcccug

SEQ ID NO: 357 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugauauguuugauauuggguu

SEQ ID NO: 358 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caacggaaucccaaaagcagcug

SEQ ID NO: 359 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcugcgcuuggauuucgucccc

SEQ ID NO: 360 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccaguccugugccugccgccu

SEQ ID NO: 361 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugaguaccgccaugucuguuggg

SEQ ID NO: 362 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caccaggcauuguggucucc

SEQ ID NO: 363 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacccagagcaugcagugugaa

SEQ ID NO: 364 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucugcccccuccgcugcugcca

SEQ ID NO: 365 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cccugugcccggcccacuucug

SEQ ID NO: 366 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ggaggggucccgcacugggagg

SEQ ID NO: 367 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccccagggcgacgcggcggg

SEQ ID NO: 368 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
accuugccuugcugcccgggcc

SEQ ID NO: 369 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugaccuaugaauugacagcc

SEQ ID NO: 370 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugccaauuccauaggucacag

SEQ ID NO: 371 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacuggccuacaaagucccagu

SEQ ID NO: 372 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugggucuuugcgggcgagauga

SEQ ID NO: 373 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacuggcccucaaagucccgcu

SEQ ID NO: 374 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cgggguuuugagggcgagauga

SEQ ID NO: 375 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uguaacagcaacuccaugugga

SEQ ID NO: 376 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccaguggggcugcuguuaucug

SEQ ID NO: 377 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagcagcacagaaauauuggc

SEQ ID NO: 378 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccaauauuggcugugcugcucc

SEQ ID NO: 379 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagguaguuucauguuguuggg

SEQ ID NO: 380 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cggcaacaagaaacugccugag

SEQ ID NO: 381 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagguaguuuccuguuguuggg

SEQ ID NO: 382 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucaccaccuucuccacccagc

SEQ ID NO: 383 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gguccagaggggagauagguuc

SEQ ID NO: 384 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cccaguguucagacuaccuguuc

SEQ ID NO: 385 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acaguagucugcacauugguua

SEQ ID NO: 386 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cccaguguuuagacuaucuguuc

SEQ ID NO: 387 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugugcaaaucuaugcaaaacuga

SEQ ID NO: 388 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aguuuugcauaguugcacuaca

SEQ ID NO: 389 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugugcaaauccaugcaaaacuga

SEQ ID NO: 390 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aguuuugcagguuugcauccagc

SEQ ID NO: 391 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aguuuugcagguuugcauuuca

SEQ ID NO: 392 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaacacugucugguaacgaugu

SEQ ID NO: 393 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caucuuaccggacagugcugga

SEQ ID NO: 394 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaauacugccugguaaugauga

SEQ ID NO: 395 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caucuuacugggcagcauugga

SEQ ID NO: 396 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaauacugccggguaaugaugga

SEQ ID NO: 397 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cgucuuacccagcaguguuugg

SEQ ID NO: 398 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agagguauagggcaugggaa

SEQ ID NO: 399 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuccuaugcauauacuucuuug

SEQ ID NO: 400 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugaaauguuuaggaccacuag

SEQ ID NO: 401 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucccuuugucauccuaugccu

SEQ ID NO: 402 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uccuucauuccaccggagucug

SEQ ID NO: 403 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggaauguaaggaagugugugg

SEQ ID NO: 404 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auaagacgagcaaaaagcuugu

SEQ ID NO: 405 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auaagacgaacaaaagguuugu

SEQ ID NO: 406 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaaagugcuuauagugcagguag

SEQ ID NO: 407 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acugcauuaugagcacuuaaag

SEQ ID NO: 408 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaagugcucauagugcagguag

SEQ ID NO: 409 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acuguaguaugggcacuuccag

SEQ ID NO: 410 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagcuuaucagacugauguuga

SEQ ID NO: 411 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caacaccagucgaugggcugu

SEQ ID NO: 412 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugugcgugugacagcggcuga

SEQ ID NO: 413 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucccuuugucauccuucgccu

SEQ ID NO: 414 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaacagucuccagucacggcc

SEQ ID NO: 415 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acagcaggcacagacaggcagu

SEQ ID NO: 416 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugccugucuacacuugcugugc

SEQ ID NO: 417 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
augaccuaugaauugacagac

SEQ ID NO: 418 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaaucucagcuggcaacuguga

SEQ ID NO: 419 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaucucugcaggcaaauguga

SEQ ID NO: 420 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacugcaucaggaacugauugga

SEQ ID NO: 421 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uugugcuugaucuaaccaugu

SEQ ID NO: 422 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
augguuccgucaagcaccaugg

SEQ ID NO: 423 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caugguucugucaagcaccgcg

SEQ ID NO: 424 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agaguugagucuggacgucccg

SEQ ID NO: 425 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agaauuguggcuggacaucugu

SEQ ID NO: 426 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugauuguccaaacgcaauucu

SEQ ID NO: 427 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aagcugccaguugaagaacugu

SEQ ID NO: 428 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aguucuucaguggcaagcuuua

SEQ ID NO: 429 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccacaccguaucugacacuuu

SEQ ID NO: 430 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccaccaccgugucugacacuu

SEQ ID NO: 431 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acacagggcuguugugaagacu

SEQ ID NO: 432 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agcuacauugucugcuggguuuc

SEQ ID NO: 433 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
accuggcauacaauguagauuu

SEQ ID NO: 434 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agcuacaucuggcuacugggu

SEQ ID NO: 435 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cucaguagccaguguagauccu

SEQ ID NO: 436 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugucaguuugucaaauacccca

SEQ ID NO: 437 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cguguauuugacaagcugaguu

SEQ ID NO: 438 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caagucacuagugguuccguu

SEQ ID NO: 439 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aucacauugccagggauuucc

SEQ ID NO: 440 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gggguuccuggggaugggauuu

SEQ ID NO: 441 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aucacauugccagggauuacc

SEQ ID NO: 442 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggguuccuggcaugcugauuu

SEQ ID NO: 443 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggcucaguucagcaggaacag

SEQ ID NO: 444 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugccuacugagcugauaucagu

SEQ ID NO: 445 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugccuacugagcugaaacacag

SEQ ID NO: 446 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cauugcacuugucucggucuga

SEQ ID NO: 447 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggcggagacuugggcaauug

SEQ ID NO: 448 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucaaguaauccaggauaggcu

SEQ ID NO: 449 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccuauucuugguuacuugcacg

SEQ ID NO: 450 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccuauucuugauuacuuguuuc

SEQ ID NO: 451 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucaaguaauucaggauaggu

SEQ ID NO: 452 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccuguucuccauuacuuggcuc

SEQ ID NO: 453 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucacaguggcuaaguuccgc

SEQ ID NO: 454 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agggcuuagcugcuugugagca

SEQ ID NO: 455 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucacaguggcuaaguucugc

SEQ ID NO: 456 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agagcuuagcugauuggugaac

SEQ ID NO: 457 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cacuagauugugagcuccugga

SEQ ID NO: 458 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaggagcucacagucuauugag

SEQ ID NO: 459 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaggguuggguggaggcucucc

SEQ ID NO: 460 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agggcccccccucaauccugu

SEQ ID NO: 461 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auguaugugugcaugugcaug

SEQ ID NO: 462 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agcagaagcagggagguucuccca

SEQ ID NO: 463 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaugugggaugguaaaccgcuu

SEQ ID NO: 464 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugguuuaccgucccacauacau

SEQ ID NO: 465 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagcaccaucugaaaucgguua

SEQ ID NO: 466 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acugauuucuuuugguguucag

SEQ ID NO: 467 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagcaccauuugaaaucaguguu

SEQ ID NO: 468 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcugguuucauauggugguuuaga

SEQ ID NO: 469 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugguuucacaugguggcuuag

SEQ ID NO: 470 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagcaccauuugaaaucgguua

SEQ ID NO: 471 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugaccgauuucuccugguguuc

SEQ ID NO: 472 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uauacaagggcagacucucucu

SEQ ID NO: 473 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cagugcaauaguauugucaaagc

SEQ ID NO: 474 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cagugcaaugauauugucaaagc

SEQ ID NO: 475 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaagugcuuccauguuuugguga

SEQ ID NO: 476 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acuuaaacguggauguacuugcu

SEQ ID NO: 477 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaagugcuuccauguuuuaguag

SEQ ID NO: 478 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acuuuaacauggaagugcuuuc

SEQ ID NO: 479 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaagugcuuccauguuucagugg

SEQ ID NO: 480 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuuaacauggggguaccugcug

SEQ ID NO: 481 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaagugcuuccauguuugagugu

SEQ ID NO: 482 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acuuuaacauggaggcacuugc

SEQ ID NO: 483 - RNA, 17 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaagugcuuccaugcuu

SEQ ID NO: 484 - RNA, 17 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaauugcuuccauguuu

SEQ ID NO: 485 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uguaaacauccucgacuggaag

SEQ ID NO: 486 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuuucagucggauguuugcagc

SEQ ID NO: 487 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uguaaacauccuacacucagcu

SEQ ID NO: 488 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugggagguggauguuuacuuc

SEQ ID NO: 489 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uguaaacauccuacacucucagc

SEQ ID NO: 490 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugggagaggguuguuuacucc

SEQ ID NO: 491 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugggagaaggcuguuuacucu

SEQ ID NO: 492 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uguaaacauccccgacuggaag

SEQ ID NO: 493 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuuucagucagauguuugcugc

SEQ ID NO: 494 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uguaaacauccuugacuggaag

SEQ ID NO: 495 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuuucagucggauguuuacagc

SEQ ID NO: 496 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggcaagaugcuggcauagcu

SEQ ID NO: 497 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugcuaugccaacauauugccau

SEQ ID NO: 498 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uauugcacauuacuaaguugca

SEQ ID NO: 499 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caauuuagugugugugauauuu

SEQ ID NO: 500 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaagcuggguugagagggcga

SEQ ID NO: 501 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaagcuggguugagagggcaa

SEQ ID NO: 502 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaagcuggguugagagggu

SEQ ID NO: 503 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaagcuggguugagagga

SEQ ID NO: 504 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cacauuacacggucgaccucu

SEQ ID NO: 505 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggugguccguggcgcguucgc

SEQ ID NO: 506 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acugccccaggugcugcugg

SEQ ID NO: 507 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cgcauccccuagggcauuggugu

SEQ ID NO: 508 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccuaguagguguccaguaagugu

SEQ ID NO: 509 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccucugggcccuuccuccag

SEQ ID NO: 510 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuggcccucucugcccuuccgu

SEQ ID NO: 511 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacacaccugguuaaccucuuu

SEQ ID NO: 512 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcaaagcacacggccugcagaga

SEQ ID NO: 513 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucucugggccugugucuuaggc

SEQ ID NO: 514 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gccccugggccuauccuagaa

SEQ ID NO: 515 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuagguauggucccagggaucc

SEQ ID NO: 516 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucaagagcaauaacgaaaaaugu

SEQ ID NO: 517 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuuuucauuauugcuccugacc

SEQ ID NO: 518 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuccuauaugaugccuuucuuc

SEQ ID NO: 519 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaacggcuucauacaggaguu

SEQ ID NO: 520 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uccagcaucagugauuuuguug

SEQ ID NO: 521 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacaauauccuggugcugagug

SEQ ID NO: 522 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagcgccucgacgacagagccg

SEQ ID NO: 523 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucccuguccuccaggagcucacg

SEQ ID NO: 524 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugcauuguaguugcauugca

SEQ ID NO: 525 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caauguuuccacagugcaucac

SEQ ID NO: 526 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugcauugcuguugcauugc

SEQ ID NO: 527 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cagugccucggcagugcagccc

SEQ ID NO: 528 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuauaaagcaaugagacugauu

SEQ ID NO: 529 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uccgucucaguuacuuuauagc

SEQ ID NO: 530 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucucacacagaaaucgcacccgu

SEQ ID NO: 531 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggggugcuaucugugauuga

SEQ ID NO: 532 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcugacuccuaguccagggcuc

SEQ ID NO: 533 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugucugcccgcaugccugccucu

SEQ ID NO: 534 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggcagugucuuagcugguugu

SEQ ID NO: 535 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaucagcaaguauacugcccu

SEQ ID NO: 536 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaucacuaacuccacugccau

SEQ ID NO: 537 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaggcagugucauuagcugauug

SEQ ID NO: 538 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaucacuaaccacacggccagg

SEQ ID NO: 539 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggcaguguaguuagcugauugc

SEQ ID NO: 540 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucccccaggugugauucugauuu

SEQ ID NO: 541 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuaucagaaucuccagggguac

SEQ ID NO: 542 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacacaccuauucaaggauuca

SEQ ID NO: 543 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aauccuuggaaccuaggugugagu

SEQ ID NO: 544 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aauugcacgguauccaucugua

SEQ ID NO: 545 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cggguggaucacgaugcaauuu

SEQ ID NO: 546 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaaugccccuaaaaauccuuau

SEQ ID NO: 547 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aauugcacuuuagcaaugguga

SEQ ID NO: 548 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acuguugcuaauaugcaacucu

SEQ ID NO: 549 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aauaauacaugguugaucuuu

SEQ ID NO: 550 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agaucgaccguguuauauucgc

SEQ ID NO: 551 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gccugcugggguggaaccuggu

SEQ ID NO: 552 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aagugccgccaucuuuugagugu

SEQ ID NO: 553 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acucaaacugugggggcacu

SEQ ID NO: 554 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaagugcugcgacauuugagcgu

SEQ ID NO: 555 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaagugcuucgauuuuggggugu

SEQ ID NO: 556 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acucaaaaugggggcgcuuucc

SEQ ID NO: 557 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuauaauacaaccugauaagug

SEQ ID NO: 558 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuuaucagauuguauuguaauu

SEQ ID NO: 559 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auauaauacaaccugcuaagug

SEQ ID NO: 560 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuuagcagguuguauuaucauu

SEQ ID NO: 561 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuuguucguucggcucgcguga

SEQ ID NO: 562 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aucauagaggaaaauccacgu

SEQ ID NO: 563 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
guagauucuccuucuaugagua

SEQ ID NO: 564 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aucauagaggaaaauccauguu

SEQ ID NO: 565 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacauagaggaaauuccacgu

SEQ ID NO: 566 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aucacacaaaggcaacuuuugu

SEQ ID NO: 567 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agagguugcccuuggugaauuc

SEQ ID NO: 568 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acuggacuuggagucagaagg

SEQ ID NO: 569 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuccugacuccagguccugugu

SEQ ID NO: 570 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugguagacuauggaacguagg

SEQ ID NO: 571 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uauguaacaugguccacuaacu

SEQ ID NO: 572 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uauguaauaugguccacaucuu

SEQ ID NO: 573 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugguugaccauagaacaugcgc

SEQ ID NO: 574 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uauacaagggcaagcucucugu

SEQ ID NO: 575 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaaguuguucgugguggauucg

SEQ ID NO: 576 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agaucagaaggugauuguggcu

SEQ ID NO: 577 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auuccuagaaauuguucaua

SEQ ID NO: 578 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaauguugcucggugaaccccu

SEQ ID NO: 579 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agguuacccgagcaacuuugcau

SEQ ID NO: 580 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aauauaacacagauggccugu

SEQ ID NO: 581 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaguagaccguauagcguacg

SEQ ID NO: 582 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uauguaacacgguccacuaacc

SEQ ID NO: 583 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acuucaccugguccacuagccgu

SEQ ID NO: 584 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aucaacagacauuaauugggcgc

SEQ ID NO: 585 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acuggacuuagggucagaaggc

SEQ ID NO: 586 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agcucggucugaggccccucagu

SEQ ID NO: 587 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugaggggcagagagcgagacuuu

SEQ ID NO: 588 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cagcagcaauucauguuuugaa

SEQ ID NO: 589 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaaacgugaggcgcugcuau

SEQ ID NO: 590 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaugacacgaucacucccguuga

SEQ ID NO: 591 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aucgggaaugucguguccgccc

SEQ ID NO: 592 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaauacugucugguaaaaccgu

SEQ ID NO: 593 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugucuugcaggccgucaugca

SEQ ID NO: 594 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caggucgucuugcagggcuucu

SEQ ID NO: 595 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucuuggaguaggucauugggugg

SEQ ID NO: 596 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuggauggcuccuccaugucu

SEQ ID NO: 597 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aucaugaugggcuccucggugu

SEQ ID NO: 598 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uugcauauguaggaugucccau

SEQ ID NO: 599 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggcaguguauuguuagcuggu

SEQ ID NO: 600 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggcaguguauuguuagcuggc

SEQ ID NO: 601 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuuugcgauguguuccuaauau

SEQ ID NO: 602 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uugggaucauuuugcauccaua

SEQ ID NO: 603 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuuugcaauauguuccugaaua

SEQ ID NO: 604 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaccguuaccauuacugaguu

SEQ ID NO: 605 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacuguuugcagaggaaacuga

SEQ ID NO: 606 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cucaucugcaaagaaguaagug

SEQ ID NO: 607 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agguuguccguggugaguucgca

SEQ ID NO: 608 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagugcaauauugcuuauagggu

SEQ ID NO: 609 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acccuaucaauauugucucugc

SEQ ID NO: 610 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcaguccaugggcauauacac

SEQ ID NO: 611 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaugugccuuuggacuacaucg

SEQ ID NO: 612 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucacuccucuccucccgucuu

SEQ ID NO: 613 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aagacgggaggaaagaagggag

SEQ ID NO: 614 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucaggcucaguccccucccgau

SEQ ID NO: 615 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gucauacacggcucuccucucu

SEQ ID NO: 616 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agaggcuggccgugaugaauuc

SEQ ID NO: 617 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cggggcagcucaguacaggau

SEQ ID NO: 618 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uccuguacugagcugccccgag

SEQ ID NO: 619 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaucauacagggacauccaguu

SEQ ID NO: 620 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaucguacagggucauccacuu

SEQ ID NO: 621 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uugaaaggcuauuucuugguc

SEQ ID NO: 622 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cccagauaauggcacucucaa

SEQ ID NO: 623 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugacaucacauauacggcagc

SEQ ID NO: 624 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaccuggaggacuccaugcug

SEQ ID NO: 625 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccauggaucuccaggugggu

SEQ ID NO: 626 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuuaugcaagauucccuucuac

SEQ ID NO: 627 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aguggggaacccuuccaugagg

SEQ ID NO: 628 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggaccugcgggacaagauucuu

SEQ ID NO: 629 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugaaggucuacugugugccagg

SEQ ID NO: 630 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuguacaugguaggcuuucauu

SEQ ID NO: 631 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugaaacauacacgggaaaccuc

SEQ ID NO: 632 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaacaaacauggugcacuucuu

SEQ ID NO: 633 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugaguauuacauggccaaucuc

SEQ ID NO: 634 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cagcagcacacugugguuugu

SEQ ID NO: 635 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaaccacacugugguguuaga

SEQ ID NO: 636 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuucaagccagggggcguuuuuc

SEQ ID NO: 637 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacaucacagcaagucugugcu

SEQ ID NO: 638 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuaagacuugcagugauguuu

SEQ ID NO: 639 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaauccuugcuaccugggugaga

SEQ ID NO: 640 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
augcaccugggcaaggauucug

SEQ ID NO: 641 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaugcacccgggcaaggauucu

SEQ ID NO: 642 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aauccuuugucccugggugaga

SEQ ID NO: 643 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaugcaccugggcaaggauuca

SEQ ID NO: 644 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auccuugcuaucugggugcua

SEQ ID NO: 645 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagcagcgggaacaguucugcag

SEQ ID NO: 646 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agacccuggucugcacucuauc

SEQ ID NO: 647 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cgucaacacuugcugguuuccu

SEQ ID NO: 648 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gggagccaggaaguauugaugu

SEQ ID NO: 649 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaaggcacccuucugaguaga

SEQ ID NO: 650 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuuugcaccuuuuggagugaa

SEQ ID NO: 651 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugauuguagccuuuuggaguaga

SEQ ID NO: 652 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacuccagagggcgucacucaug

SEQ ID NO: 653 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacugcagacguggcaaucaug

SEQ ID NO: 654 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugauugguacgucuguggguag

SEQ ID NO: 655 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacugcagacaguggcaauca

SEQ ID NO: 656 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacucaggagaguggcaaucac

SEQ ID NO: 657 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugucuuuugcucugcaguca

SEQ ID NO: 658 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aagugcugucauagcugagguc

SEQ ID NO: 659 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cacucagccuugagggcacuuuc

SEQ ID NO: 660 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaaauuucaccuuucugagaagg

SEQ ID NO: 661 - RNA, 18 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucacagggaggugucau

SEQ ID NO: 662 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucacaaggaggugucauuuau

SEQ ID NO: 663 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucucaaggaggugucguuuau

SEQ ID NO: 664 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auugacacuucugugaguaga

SEQ ID NO: 665 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gagugccuucuuuuggagcguu

SEQ ID NO: 666 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucuccaaaagaaagcacuuucug

SEQ ID NO: 667 - RNA, 18 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugcuuccuuucagagggu

SEQ ID NO: 668 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucucgaggaaagaagcacuuuc

SEQ ID NO: 669 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aucuggagguaagaagcacuuu

SEQ ID NO: 670 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccucuagauggaagcacugucu

SEQ ID NO: 671 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aucgugcaucccuuuagagugu

SEQ ID NO: 672 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucgugcaucccuuuagaguguu

SEQ ID NO: 673 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aucgugcauccuuuuagagugu

SEQ ID NO: 674 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaaagcgcuucccuuugcugga

SEQ ID NO: 675 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaagcgcuccccuuuagaggu

SEQ ID NO: 676 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaagcgcuucucuuuagagugu

SEQ ID NO: 677 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucucuggagggaagcacuuucug

SEQ ID NO: 678 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaagcgcuucccuuuggagc

SEQ ID NO: 679 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cucuagagggaagcacuuucug

SEQ ID NO: 680 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaagcgcuucccuucagagug

SEQ ID NO: 681 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaaagcgcuucucuuuagagg

SEQ ID NO: 682 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cucuagagggaagcacuuucuc

SEQ ID NO: 683 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaagugcauccuuuuagagugu

SEQ ID NO: 684 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cucuagagggaagcgcuuucug

SEQ ID NO: 685 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaagugcauccuuuuagagguu

SEQ ID NO: 686 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaagugcaucuuuuuagaggau

SEQ ID NO: 687 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaagugccucccuuuagagug

SEQ ID NO: 688 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aagugccuccuuuuagaguguu

SEQ ID NO: 689 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucuccaaaagggagcacuuuc

SEQ ID NO: 690 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaagugcuucccuuuggacugu

SEQ ID NO: 691 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuccagagggaaguacuuucu

SEQ ID NO: 692 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaagugcuuccuuuuagaggg

SEQ ID NO: 693 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaagugcuuccuuuuagagggu

SEQ ID NO: 694 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaagugcuucucuuuggugggu

SEQ ID NO: 695 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuacaaagggaagcccuuuc

SEQ ID NO: 696 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaagugcuuccuuuuugaggg

SEQ ID NO: 697 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aagugcuuccuuuuagaggguu

SEQ ID NO: 698 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acaaagugcuucccuuuagagugu

SEQ ID NO: 699 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acaaagugcuucccuuuagagu

SEQ ID NO: 700 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacgcacuucccuuuagagugu

SEQ ID NO: 701 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaaugguucccuuuagagugu

SEQ ID NO: 702 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaacgcgcuucccuauagagggu

SEQ ID NO: 703 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaaggcgcuucccuuuggagu

SEQ ID NO: 704 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuacaaagggaagcacuuucuc

SEQ ID NO: 705 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaaggcgcuucccuuuagagcg

SEQ ID NO: 706 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuccagagggaugcacuuucu

SEQ ID NO: 707 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cucuugagggaagcacuuucugu

SEQ ID NO: 708 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaaagugcuuccuuuuagaggc

SEQ ID NO: 709 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugcaaagggaagcccuuuc

SEQ ID NO: 710 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccucccacacccaaggcuugca

SEQ ID NO: 711 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caugccuugaguguaggaccgu

SEQ ID NO: 712 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ggagaaauuauccuuggugugu

SEQ ID NO: 713 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggugggcacagaaucuggacu

SEQ ID NO: 714 - RNA, 25 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaggauucugcugucggucccacu

SEQ ID NO: 715 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugugacagauugauaacugaaa

SEQ ID NO: 716 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucggggaucaucaugucacgaga

SEQ ID NO: 717 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaacauucgcggugcacuucuu

SEQ ID NO: 718 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auucugcauuuuuagcaaguuc

SEQ ID NO: 719 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucagcaaacauuuauugugugc

SEQ ID NO: 720 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucaguaaauguuuauuagauga

SEQ ID NO: 721 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaaacuggcaauuacuuuugc

SEQ ID NO: 722 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaaguaauugcgaguuuuacc

SEQ ID NO: 723 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caagaaccucaguugcuuuugu

SEQ ID NO: 724 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaaguaauugugguuuuggcc

SEQ ID NO: 725 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaaaaucucaauuacuuuugc

SEQ ID NO: 726 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaaguaauugcgguuuuugcc

SEQ ID NO: 727 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaaaaccacaguuucuuuugc

SEQ ID NO: 728 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaaguaauugugguuuuugcc

SEQ ID NO: 729 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaaacugagacuacuuuugca

SEQ ID NO: 730 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaaacuguaauuacuuuu

SEQ ID NO: 731 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaacuguaauuacuuuuguac

SEQ ID NO: 732 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaaguaaucgcgguuuuuguc

SEQ ID NO: 733 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaaguaauugcggauuuugcc

SEQ ID NO: 734 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaaguaauugcggucuuuggu

SEQ ID NO: 735 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaaguacuugcggauuuugcu

SEQ ID NO: 736 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaaguauuugcggguuuuguc

SEQ ID NO: 737 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaagguauuugugguuuuug

SEQ ID NO: 738 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaaaguaauuguggauuuugu

SEQ ID NO: 739 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccaaaacugcaguuacuuuugc

SEQ ID NO: 740 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagcaaaaacugcaguuacuuu

SEQ ID NO: 741 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugacaacuauggaugagcucu

SEQ ID NO: 742 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agugccugagggaguaagagccc

SEQ ID NO: 743 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugucuuacucccucaggcacau

SEQ ID NO: 744 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcgacccacucuugguuucca

SEQ ID NO: 745 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcgacccauacuugguuucag

SEQ ID NO: 746 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaaaucaagcgugggugagacc

SEQ ID NO: 747 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacaggugacugguuagacaa

SEQ ID NO: 748 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaacggugagauuuuguuuu

SEQ ID NO: 749 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcuaguccugacucagccagu

SEQ ID NO: 750 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggguaagcugaaccucugau

SEQ ID NO: 751 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auauuaccauuagcucaucuuu

SEQ ID NO: 752 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaugagcucauuguaauaugag

SEQ ID NO: 753 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
guuugcacgggugggccuugucu

SEQ ID NO: 754 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagcugcuguaccaaaau

SEQ ID NO: 755 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaaaguaaauaugcaccaaaa

SEQ ID NO: 756 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaaguuuaagauccuugaagu

SEQ ID NO: 757 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaguagcuguaccauuugc

SEQ ID NO: 758 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agguugacauacguuuccc

SEQ ID NO: 759 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggcacggugucagcaggc

SEQ ID NO: 760 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gggcgccugugaucccaac

SEQ ID NO: 761 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aguauguucuuccaggacagaac

SEQ ID NO: 762 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auguauaaauguauacacac

SEQ ID NO: 763 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aguuaaugaauccuggaaagu

SEQ ID NO: 764 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cgaaaacagcaauuaccuuugc

SEQ ID NO: 765 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugaguuggccaucugagugag

SEQ ID NO: 766 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
guccgcucggcgguggccca

SEQ ID NO: 767 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugaagugauguguaacugaucag

SEQ ID NO: 768 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cacgcucaugcacacacccaca

SEQ ID NO: 769 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagugugugugugugagugugu

SEQ ID NO: 770 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gagccaguuggacaggagc

SEQ ID NO: 771 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aagauguggaaaaauuggaauc

SEQ ID NO: 772 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auucuaauuucuccacgucuuu

SEQ ID NO: 773 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagauaaaauauugguaccug

SEQ ID NO: 774 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuucuugugcucuaggauugu

SEQ ID NO: 775 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucauuugguauaaaccgcgauu

SEQ ID NO: 776 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uugagaaugaugaaucauuagg

SEQ ID NO: 777 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucuuguguucucuagaucagu

SEQ ID NO: 778 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaacugguugaacaacugaacc

SEQ ID NO: 779 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuacaguuguucaaccaguuacu

SEQ ID NO: 780 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaagaggaaggucccauuac

SEQ ID NO: 781 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuaugguuugccugggacugag

SEQ ID NO: 782 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugggcguaucuguaugcua

SEQ ID NO: 783 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaugcauuguauuuuuaggucc

SEQ ID NO: 784 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuuccauaggugaugagucac

SEQ ID NO: 785 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuggccacaauggguuagaac

SEQ ID NO: 786 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagaaccacgucugcucugag

SEQ ID NO: 787 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucagaacaaaugccgguucccaga

SEQ ID NO: 788 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaauuuuauguauaagcuagu

SEQ ID NO: 789 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gagcuuauucauaaaagugcag

SEQ ID NO: 790 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agaccauggguucucauugu

SEQ ID NO: 791 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uugugucaauaugcgaugaugu

SEQ ID NO: 792 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugucucugcugggguuucu

SEQ ID NO: 793 - RNA, 25 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggcaccagccaggcauugcucagc

SEQ ID NO: 794 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaagugugccguggugugucu

SEQ ID NO: 795 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aagccugcccggcuccucggg

SEQ ID NO: 796 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugugucacucgaugaccacugu

SEQ ID NO: 797 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacgucaucguugucaucguca

SEQ ID NO: 798 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
guugugucaguuuaucaaac

SEQ ID NO: 799 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acuuacagacaagagccuugcuc

SEQ ID NO: 800 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggucuaggauuguuggaggag

SEQ ID NO: 801 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gacacgggcgacagcugcggccc

SEQ ID NO: 802 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cacacacugcaauuacuuuugc

SEQ ID NO: 803 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggcugcggaauucaggac

SEQ ID NO: 804 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaaaucccauggugccuucuccu

SEQ ID NO: 805 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaacuacugaaaaucaaagau

SEQ ID NO: 806 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
guucaaauccagaucuauaac

SEQ ID NO: 807 - RNA, 25 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggggugguguugggacagcuccgu

SEQ ID NO: 808 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggguguuucucucaucucu

SEQ ID NO: 809 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagcuaaaugugugcuggga

SEQ ID NO: 810 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcgaggaccccucggggucugac

SEQ ID NO: 811 - RNA, 25 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcugggcagggcuucugagcuccuu

SEQ ID NO: 812 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggaauguuccuucuuugcc

SEQ ID NO: 813 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaacgccuguucuugccaggugg

SEQ ID NO: 814 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uccgagccugggucucccucuu

SEQ ID NO: 815 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ggggguccccggugcucggauc

SEQ ID NO: 816 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agucauuggaggguuugagcag

SEQ ID NO: 817 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acucaaaacccuucagugacuu

SEQ ID NO: 818 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agacuucccauuugaagguggc

SEQ ID NO: 819 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaacucuacuuguccuucugagu

SEQ ID NO: 820 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gaccuggacauguuugugcccagu

SEQ ID NO: 821 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auggagauagauauagaaau

SEQ ID NO: 822 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ggcuagcaacagcgcuuaccu

SEQ ID NO: 823 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acagucugcugagguuggagc

SEQ ID NO: 824 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aucccuugcaggggcuguugggu

SEQ ID NO: 825 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cacaagguauugguauuaccu

SEQ ID NO: 826 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaguaccaguaccuuguguuca

SEQ ID NO: 827 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agggggaaaguucuauagucc

SEQ ID NO: 828 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gacuauagaacuuucccccuca

SEQ ID NO: 829 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agcugucugaaaaugucuu

SEQ ID NO: 830 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugagucucuaagaaaagagga

SEQ ID NO: 831 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucuaguaagaguggcagucga

SEQ ID NO: 832 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
augcugacauauuuacuagagg

SEQ ID NO: 833 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggguuuacguugggagaacu

SEQ ID NO: 834 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
guucucccaacguaagcccagc

SEQ ID NO: 835 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aguauucuguaccagggaaggu

SEQ ID NO: 836 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agaccuggcccagaccucagc

SEQ ID NO: 837 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugucugcuuccuguggga

SEQ ID NO: 838 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuaauaguaucuaccacaauaaa

SEQ ID NO: 839 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaccagcaccccaacuuuggac

SEQ ID NO: 840 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acuugggcacugaaacaaugucc

SEQ ID NO: 841 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugugcuugcucgucccgcccgca

SEQ ID NO: 842 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acugggggcuuucgggcucugcgu

SEQ ID NO: 843 - RNA, 25 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agggaucgcgggcggguggcggccu

SEQ ID NO: 844 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aucgcugcgguugcgagcgcugu

SEQ ID NO: 845 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
augauccaggaaccugccucu

SEQ ID NO: 846 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaagacauaggauagagucaccuc

SEQ ID NO: 847 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gucccucuccaaaugugucuug

SEQ ID NO: 848 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acuuguaugcuagcucagguag

SEQ ID NO: 849 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aguguggcuuucuuagagc

SEQ ID NO: 850 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucuaggcugguacugcuga

SEQ ID NO: 851 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aagcagcugccucugaggc

SEQ ID NO: 852 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
guggcugcacucacuuccuuc

SEQ ID NO: 853 - RNA, 19 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aagugugcagggcacuggu

SEQ ID NO: 854 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaaccuguguuguucaagaguc

SEQ ID NO: 855 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggaggcagcgcucucaggac

SEQ ID NO: 856 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuuaggauaagcuugacuuuug

SEQ ID NO: 857 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aauggcgccacuaggguugug

SEQ ID NO: 858 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
guguugaaacaaucucuacug

SEQ ID NO: 859 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaugucugcugaccaucaccuu

SEQ ID NO: 860 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggugggccgcagaacaugugc

SEQ ID NO: 861 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auaauacaugguuaaccucuuu

SEQ ID NO: 862 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aauauuauacagucaaccucu

SEQ ID NO: 863 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ggcagguucucacccucucuagg

SEQ ID NO: 864 - RNA, 25 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ggcggagggaaguagguccguuggu

SEQ ID NO: 865 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuugguucagggagggucccca

SEQ ID NO: 866 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacccauugcauaucggaguug

SEQ ID NO: 867 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugccugggucucuggccugcgcgu

SEQ ID NO: 868 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucccacguuguggcccagcag

SEQ ID NO: 869 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggcggggcgccgcgggaccgc

SEQ ID NO: 870 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gguggcccggccgugccugagg

SEQ ID NO: 871 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uauucauuuauccccagccuaca

SEQ ID NO: 872 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acuggcuagggaaaaugauuggau

SEQ ID NO: 873 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
accaggaggcugaggccccu

SEQ ID NO: 874 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugucacucggcucggcccacuac

SEQ ID NO: 875 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uccgguucucagggcuccacc

SEQ ID NO: 876 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggaagcccuggaggggcuggag

SEQ ID NO: 877 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggugcggagagggcccacagug

SEQ ID NO: 878 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuguaugcccucaccgcuca

SEQ ID NO: 879 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggaagacuagugauuuuguugu

SEQ ID NO: 880 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caacaaaucacagucugccaua

SEQ ID NO: 881 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caacaaaucccagucuaccuaa

SEQ ID NO: 882 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaggagcuuacaaucuagcuggg

SEQ ID NO: 883 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caacuagacugugagcuucuag

SEQ ID NO: 884 - RNA, 17 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucucgcuggggccucca

SEQ ID NO: 885 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugcggggcuagggcuaacagca

SEQ ID NO: 886 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuguugccacuaaccucaaccu

SEQ ID NO: 887 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuugugaccugguccacuaacc

SEQ ID NO: 888 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cggcucugggucugugggga

SEQ ID NO: 889 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggaggagaaggaaggugaug

SEQ ID NO: 890 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acuccagccccacagccucagc

SEQ ID NO: 891 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucugcucauaccccaugguuucu

SEQ ID NO: 892 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugcaccaugguugucugagcaug

SEQ ID NO: 893 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugggaucuccggggucuugguu

SEQ ID NO: 894 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagaccucuggguucugagcu

SEQ ID NO: 895 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uccaguaccacgugucagggcca

SEQ ID NO: 896 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caguaacaaagauucauccuugu

SEQ ID NO: 897 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcaggaacuugugagucuccu

SEQ ID NO: 898 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugcccuggcccgagggaccga

SEQ ID NO: 899 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccuggaaacacugagguugug

SEQ ID NO: 900 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uauaccucaguuuuaucaggug

SEQ ID NO: 901 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggugguuuacaaaguaauuca

SEQ ID NO: 902 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggauuucuuugugaaucacca

SEQ ID NO: 903 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
guagaggagauggcgcaggg

SEQ ID NO: 904 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uccucuucucccuccucccag

SEQ ID NO: 905 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aggcagcgggguguaguggaua

SEQ ID NO: 906 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uccauuacacuacccugccucu

SEQ ID NO: 907 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cgcgggugcuuacugacccuu

SEQ ID NO: 908 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cgggucggaguuagcucaagcgg

SEQ ID NO: 909 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gugaacgggcgccaucccgagg

SEQ ID NO: 910 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacucaaaaagcugucaguca

SEQ ID NO: 911 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gacugacaccucuuugggugaa

SEQ ID NO: 912 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuaauaucggacaaccauugu

SEQ ID NO: 913 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uacuuggaaaggcaucaguug

SEQ ID NO: 914 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugcaacgaaccugagccacuga

SEQ ID NO: 915 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugcaacuuaccugagucauuga

SEQ ID NO: 916 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cacuguguccuuucugcguag

SEQ ID NO: 917 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cacuggcuccuuucuggguaga

SEQ ID NO: 918 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucuuugguuaucuagcuguauga

SEQ ID NO: 919 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auaaagcuagauaaccgaaagu

SEQ ID NO: 920 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ggggagcuguggaagcagua

SEQ ID NO: 921 - RNA, 25 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuagugagggacagaaccaggauuc

SEQ ID NO: 922 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gcagcagagaauaggacuacguc

SEQ ID NO: 923 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gucagcggaggaaaagaaacu

SEQ ID NO: 924 - RNA, 20 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agagucuugugaugucuugc

SEQ ID NO: 925 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uauugcacuugucccggccugu

SEQ ID NO: 926 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agguugggaucgguugcaaugcu

SEQ ID NO: 927 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ggguggggauuuguugcauuac

SEQ ID NO: 928 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uauugcacucgucccggccucc

SEQ ID NO: 929 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agggacgggacgcggugcagug

SEQ ID NO: 930 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caaagugcuguucgugcagguag

SEQ ID NO: 931 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acugcugagcuagcacuucccg

SEQ ID NO: 932 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugugcgcagggagaccucuccc

SEQ ID NO: 933 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugucuacuacuggagacacugg

SEQ ID NO: 934 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccaguuaccgcuuccgcuaccgc

SEQ ID NO: 935 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acaguagagggaggaaucgcag

SEQ ID NO: 936 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auccgcgcucugacucucugcc

SEQ ID NO: 937 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugcccuuaaaggugaacccagu

SEQ ID NO: 938 - RNA, 24 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggggagcugaggcucugggggug

SEQ ID NO: 939 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaggcagggcccccgcucccc

SEQ ID NO: 940 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cacccggcugugugcacaugugc

SEQ ID NO: 941 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucuucucuguuuuggccaugug

SEQ ID NO: 942 - RNA, 21 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugacuguugccguccuccag

SEQ ID NO: 943 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaauuauuguacaucggaugag

SEQ ID NO: 944 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uucaacggguauuuauugagca

SEQ ID NO: 945 - RNA, 23 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuuggcacuagcacauuuuugcu

SEQ ID NO: 946 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aaucaugugcagugccaauaug

SEQ ID NO: 947 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugagguaguaaguuguauuguu

SEQ ID NO: 948 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacccguagauccgaucuugug

SEQ ID NO: 949 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caagcucgcuucuaugggucug

SEQ ID NO: 950 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cacccguagaaccgaccuugcg

SEQ ID NO: 951 - RNA, 22 nt, Homo sapiens
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
caagcucgugucuguggguccg

SEQ ID NO: 952 - RNA, 21 nt, Herpes simplex virus 1
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uggaaggacgggaaguggaag

SEQ ID NO: 953 - RNA, 24 nt, Herpes simplex virus 1
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccugagccagggacgagugcgacu

SEQ ID NO: 954 - RNA, 22 nt, Herpes simplex virus 1
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucgcacgcgcccggcacagacu

SEQ ID NO: 955 - RNA, 20 nt, Herpes simplex virus 1
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cugggacugugcgguuggga

SEQ ID NO: 956 - RNA, 22 nt, Herpes simplex virus 1
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuugccugucuaacucgcuagu

SEQ ID NO: 957 - RNA, 22 nt, Herpes simplex virus 1
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gguagaguuugacaggcaagca

SEQ ID NO: 958 - RNA, 22 nt, Herpes simplex virus 1
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
gucagagauccaaacccuccgg

SEQ ID NO: 959 - RNA, 21 nt, Herpes simplex virus 1
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cacuucccguccuuccauccc

SEQ ID NO: 960 - RNA, 23 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
auuacaggaaacuggguguaagc

SEQ ID NO: 961 - RNA, 22 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaguguuguccccccgaguggc

SEQ ID NO: 962 - RNA, 22 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugguguuguccccccgaguggc

SEQ ID NO: 963 - RNA, 22 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uuaaugcuuagccuguguccga

SEQ ID NO: 964 - RNA, 22 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
accaggccaccauuccucuccg

SEQ ID NO: 965 - RNA, 22 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
aacuguaguccgggucgaucug

SEQ ID NO: 966 - RNA, 23 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucacauucugaggacggcagcga

SEQ ID NO: 967 - RNA, 21 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ucgcggucacagaaugugaca

SEQ ID NO: 968 - RNA, 22 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uagaauacugaggccuagcuga

SEQ ID NO: 969 - RNA, 22 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
agcuaaaccgcaguacucuagg

SEQ ID NO: 970 - RNA, 22 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaggaugccuggaacuugccgg

SEQ ID NO: 971 - RNA, 22 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugaugguuuucgggcuguugag

SEQ ID NO: 972 - RNA, 22 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ccagcagcaccuaauccaucgg

SEQ ID NO: 973 - RNA, 21 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
ugaucccauguugcuggcgcu

SEQ ID NO: 974 - RNA, 22 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
uaggcgcgacugagagagcacg

SEQ ID NO: 975 - RNA, 22 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
cuggguauacgcagcugcguaa

SEQ ID NO: 976 - RNA, 22 nt, Kaposi sarcoma-associated herpesvirus
  misc_feature (2)..(8): Sequence of 7-mer microRNA inhibitor corresponds to reverse complement of 2..8 subsequence
  misc_feature (2)..(9): Sequence of 8-mer microRNA inhibitor corresponds to reverse complement of 2..9 subsequence
  misc_feature (2)..(10): Sequence of 9-mer microRNA inhibitor corresponds to reverse complement of 2..10 subsequence
acccagcugcguaaaccccgcu

SEQ ID NO: 977 - DNA, 14 bp, artificial
  LNA Oligomer
  misc_feature (1)..(14): Full LNA & Phosphorothioate linkages,
cacgattagcatta

SEQ ID NO: 978 - DNA, 6 bp, artificial
  LNA Oligomer
  misc_feature (1)..(6): Full LNA & Phosphorothioate linkages,
gcatta

SEQ ID NO: 979 - DNA, 7 bp, artificial
  LNA Oligomer
  misc_feature (1)..(7): Full LNA & Phosphorothioate linkages,
agcatta

SEQ ID NO: 980 - DNA, 10 bp, artificial
  LNA Oligomer
  misc_feature (1)..(10): Full LNA & Phosphorothioate linkages,
attagcatta

SEQ ID NO: 981 - DNA, 10 bp, artificial
  LNA Oligomer
gtcacactcc

SEQ ID NO: 982 - DNA, 9 bp, artificial
  LNA Oligomer
tcacactcc

SEQ ID NO: 983 - DNA, 8 bp, artificial
  LNA Oligomer
cacactcc

SEQ ID NO: 984 - DNA, 7 bp, artificial
  LNA Oligomer
acactcc

The invention claimed is:

1. An oligomer of a contiguous sequence of 7, 8, 9 or 10 nucleotide units in length, for use in reducing the effective amount of a microRNA target in a cell or an organism, wherein at least 70% of the nucleotide units of the oligomer are selected from the group consisting of LNA (Locked Nucleic Acid) units and 2' substituted nucleotide analogues, and wherein at least 50% of the nucleotide units of the oligomer are LNA units, and wherein at least one of the internucleoside linkages present between the nucleotide units of the contiguous nucleotide sequence is a phosphorothioate internucleoside linkage, and wherein the contiguous nucleotide sequence is complementary to a corresponding renion of the microRNA sequence of miR-122 (SEQ ID NO: 150).

2. The oligomer according to claim 1, for use in the treatment of a medical disorder or disease selected from the group consisting of: hepatitis C virus infection and hypercholesterolemia and related disorders.

3. A pharmaceutical composition comprising an oligomer according to claim 1, and a pharmaceutically acceptable diluent, carrier, salt of adjuvant.

4. The pharmaceutical composition according to claim 3, wherein the composition further comprises a second independent active ingredient that is an inhibitor of the VLDL (very-low density lipoprotein) assembly pathway or an MTP (microsomal transfer protein) inhibitor.

5. A method for the treatment of a disease or medical disorder associated with the presence or over-expression of a microRNA, comprising the step of administering a the pharmaceutical composition according to claim 3 to a patient who is suffering from, or is likely to suffer from said disease or medical disorder.

6. The oligomer according to claim 1, wherein at least 75% of the internucleoside linkages present between the nucleotide units of the contiguous nucleotide sequence are phosphorothioate internucleoside linkages.

7. The oligomer according to claim 1, wherein all the internucleoside linkages present between the nucleotide units of the contiguous nucleotide sequence are phosphorothioate internucleoside linkages.

8. The oligomer according claim 6, wherein the nucleotide analogue units are selected from the group consisting of DNA, 2'-O-alkyl-RNA unit, 2'-OMe-RNA unit, 2'-amino-DNA unit, T-fluoro-DNA unit, LNA unit, PNA unit, HNA unit, INA unit, and a 2'-MOE RNA unit.

9. The oligomer according to claim 6 which comprises a 3' terminal LNA unit and a 5' terminal LNA unit.

10. The oligomer according to claim 6, wherein the length of the oligomer is 7, 8 or 9 contiguous nucleotides, wherein the contiguous nucleotide units are independently selected from the group consisting of LNA units and 2' substituted nucleotide analogue units.

11. The oligomer according to claim 7, wherein all of the nucleotide units of the contiguous nucleotide sequence are LNA units.

12. The oligomer according to claim 1, wherein the contiguous nucleotide sequence of the oligomer is 7 nucleotide units in length, all the nucleotide units are LNA units, and all the internucleoside linkages are phosphorothioate.

13. The oligomer according to claim 1, wherein the contiguous nucleotide sequence of the oligomer is 8 nucleotide units in length, all the nucleotide units are LNA units, and all the internucleoside linkages are phosphorothioate.

14. The oligomer according to claim 1, wherein the contiguous nucleotide sequence of the oligomer is 9 nucleotide units in length, all the nucleotide units are LNA units, and all the internucleoside linkages are phosphorothioate.

15. The oligomer according to claim 1, wherein the contiguous nucleotide sequence of the oligomer is 10 nucleotide units in length, all the nucleotide units are LNA units, and all the internucleoside linkages are phosphorothioate.

16. The oligomer according to claim 1, wherein the contiguous nucleotide sequence of the oligomer comprises a sequence which is complementary to the seed sequence of miR-122 (SEQ ID NO: 150).

17. The oligomer according to claim 6, wherein the contiguous nucleotide sequence of the oligomer comprises a sequence which is complementary to the seed sequence of miR-122 (SEQ ID NO: 150).

18. The oligomer according to claim 7, wherein the contiguous nucleotide sequence of the oligomer comprises a sequence which is complementary to the seed sequence of miR-122 (SEQ ID NO: 150).

19. The oligomer according to claim 12, wherein the contiguous nucleotide sequence of the oligomer comprises a sequence which is complementary to the seed sequence of miR-122 (SEQ ID NO: 150).

20. The oligomer according to claim 13, wherein the contiguous nucleotide sequence of the oligomer comprises a sequence which is complementary to the seed sequence of miR-122 (SEQ ID NO: 150).

21. The oligomer according to claim 14, wherein the contiguous nucleotide sequence of the oligomer comprises a sequence which is complementary to the seed sequence of miR-122 (SEQ ID NO: 150).

22. The oligomer according to claim 11, wherein said contiguous nucleotide sequence of the oligomer does not comprise a nucleotide which corresponds to the first nucleotide present in the microRNA sequence of miR-122 (SEQ ID NO: 150) counted from the 5' end.

23. The oligomer according to claim 1, wherein the contiguous nucleotide sequence of the oligomer comprises a sequence selected from:
   (a) 5'-GTCACACTCC-3' (SEQ ID NO: 981),
   (b) 5'-TCACACTCC-3' (SEQ ID NO: 982),
   (c) 5'-CACACTCC-3' (SEQ ID NO: 983), or
   (d) 5'-ACACTCC-3' (SEQ ID NO: 984).

24. The oligomer according to claim 6, wherein the contiguous nucleotide sequence of the oligomer comprises a sequence selected from:
   (a) 5'-GTCACACTCC-3' (SEQ ID NO: 981),
   (b) 5'-TCACACTCC-3' (SEQ ID NO: 982),
   (c) 5'-CACACTCC-3' (SEQ ID NO: 983), or
   (d) 5'-ACACTCC-3' (SEQ ID NO: 984).

25. The oligomer according to claim 7, wherein the contiguous nucleotide sequence of the oligomer comprises a sequence selected from:
   (a) 5'-GTCACACTCC-3' (SEQ ID NO: 981),
   (b) 5'-TCACACTCC-3' (SEQ ID NO: 982),
   (b) 5'-CACACTCC-3' (SEQ ID NO: 983), or
   (c) 5'-ACACTCC-3' (SEQ ID NO: 984).

26. The oligomer according to claim 1, wherein the contiguous nucleotide sequence of the oligomer is a sequence selected from:
   (a) 5'-GTCACACTCC-3' (SEQ ID NO: 981),
   (b) 5'-TCACACTCC-3' (SEQ ID NO: 982),
   (c) 5'-CACACTCC-3' (SEQ ID NO: 983), or
   (d) 5'-ACACTCC-3' (SEQ ID NO: 984).

27. The oligomer according to claim 6, wherein the contiguous nucleotide sequence of the oligomer is a sequence selected from:
   (a) 5'-GTCACACTCC-3' (SEQ ID NO: 981),
   (b) 5'-TCACACTCC-3' (SEQ ID NO: 982),
   (c) 5'-CACACTCC-3' (SEQ ID NO: 983), or
   (d) 5'-ACACTCC-3' (SEQ ID NO: 984).

28. The oligomer according to claim 7, wherein the contiguous nucleotide sequence of the oligomer is a sequence selected from:
   (a) 5'-GTCACACTCC-3' (SEQ ID NO: 981),
   (b) 5'-TCACACTCC-3' (SEQ ID NO: 982),
   (b) 5'-CACACTCC-3' (SEQ ID NO: 983), or
   (c) 5'-ACACTCC-3' (SEQ ID NO: 984).

29. The oligomer according to claim 11, wherein the contiguous nucleotide sequence of the oligomer is 7 nucleotide units in length, all the nucleotide units are LNA units, all the internucleoside linkages are phosphorothioate, and all cytosine LNA units are 5-methylcytosines.

30. The oligomer according to claim 29, wherein the oligomer sequence comprises 5'-ACACTCC-3' (SEQ ID NO: 984).

31. The oligomer according to claim 29, wherein the oligomer sequence is 5'-ACACTCC-3' (SEQ ID NO: 984).

32. The oligomer according to claim 11, wherein the contiguous nucleotide sequence of the oligomer is 8 nucleotide units in length, all the nucleotide units are LNA units, all the internucleoside linkages are phosphorothioate, and all cytosine LNA units are 5-methylcytosines.

33. The oligomer according to claim 32, wherein the oligomer sequence comprises 5'-CACACTCC-3' (SEQ ID NO: 983).

34. The oligomer according to claim 32, wherein the oligomer sequence is 5'-CACACTCC-3' (SEQ ID NO: 983).

35. The oligomer according to claim 11, wherein the contiguous nucleotide sequence of the oligomer is 9 nucleotide units in length, all the nucleotide units are LNA units, all the internucleoside linkages are phosphorothioate, and all cytosine LNA units are 5-methylcytosines.

36. The oligomer according to claim 35, wherein the oligomer sequence comprises 5'-TCACACTCC-3' (SEQ ID NO: 982).

37. The oligomer according to claim 35, wherein the oligomer sequence is 5'-TCACACTCC-3' (SEQ ID NO: 982).

38. The oligomer according to claim 11, wherein the contiguous nucleotide sequence of the oligomer is 10 nucleotide units in length, all the nucleotide units are LNA units, all the internucleoside linkages are phosphorothioate, and all cytosine LNA units are 5-methylcytosines.

39. The oligomer according to claim 38, wherein the oligomer sequence comprises 5'-GTCACACTCC-3' (SEQ ID NO: 981).

40. The oligomer according to claim 38, wherein the oligomer sequence is 5'-GTCACACTCC-3' (SEQ ID NO: 981).

41. The method according to claim 5, wherein the disease or medical disorder is hepatitis C(HCV).

42. The oligomer according to claim 1, wherein the oligomer is conjugated with at least one non-nucleotide or non-polynucleotide moiety.

43. The oligomer according to claim 42, wherein the non-nucleotide or non-polynucleotide moiety is selected a protein, a fatty acid chain, a sugar residue, a glycoprotein, a polymer, or any combination thereof.

44. The oligomer according to claim 43, wherein the protein is an antibody.

45. The oligomer according to claim 43, wherein the polymer is polyethylene glycol.

46. The oligomer according to claim 1, wherein at least one of the internucleoside linkages present between the nucleotide units of the contiguous nucleotide sequence is not a phosphorothioate or a phosphodiester internucleoside linkage.

47. The oligomer according to claim 1, wherein at least one cytosine LNA units is not 5-methylcytosine.

48. The oligomer according to claim 1, wherein at least one cytosine LNA unit is 5-methylcytosine.

49. The oligomer according to claim 1, wherein all cytosine LNA units are 5-methylcytosines.

50. The oligomer according to claim 6, wherein at least one cytosine LNA units is not 5-methylcytosine.

51. The oligomer according to claim 6, wherein at least one cytosine LNA unit is 5-methylcytosine.

52. The oligomer according to claim 6, wherein all cytosine LNA units are 5-methylcytosines.

* * * * *

UNITED STATES PATENT AND TRADEMARK OFFICE
CERTIFICATE OF CORRECTION

| | | |
|---|---|---|
| PATENT NO. | : 8,288,356 B2 | Page 1 of 1 |
| APPLICATION NO. | : 12/245544 | |
| DATED | : October 16, 2012 | |
| INVENTOR(S) | : Obad et al. | |

It is certified that error appears in the above-identified patent and that said Letters Patent is hereby corrected as shown below:

On the Title Page: Item (54) and in Specifications, Column 1, line 1, please replace the title "MicroRNAs" with --MICROMIRs--.

At column 129, in claim 1, line 39, please replace "to a corresponding renion of the microRNA" with --to a corresponding region of the microRNA--.

At column 129, in claim 5, line 56, please replace "administering a the pharmaceutical" with --administering the pharmaceutical--.

At column 130, in claim 8, line 26, please replace "The oligomer according claim 6" with --The oligomer according to claim 6--.

At column 130, in claim 8, line 29, please replace "T-fluoro-DNA unit" with --2'-fluoro-DNA unit--.

At column 132, in claim 41, line 36, please replace "hepatitis C(HCV)" with --hepatitis C (HCV)--.

At column 132, in claim 43, line 41, please replace "moiety is selected" with --moiety is--.

At column 132, in claim 47, line 54, please replace "cytosine LNA units" with --cytosine LNA unit--.

At column 132, in claim 50, line 60, replace "cytosine LNA units" with --cytosine LNA unit--.

Signed and Sealed this
Fifteenth Day of January, 2013

David J. Kappos
*Director of the United States Patent and Trademark Office*